(12) United States Patent
Abbitt et al.

(10) Patent No.: US 12,735,718 B2
(45) Date of Patent: Sep. 15, 2026

(54) PARTHENOGENESIS FACTORS AND METHODS OF USING SAME

(71) Applicant: PIONEER HI-BRED INTERNATIONAL, INC., Johnston, IA (US)

(72) Inventors: Shane E. Abbitt, Ankeny, IA (US); Jon Aaron Tucker Reinders, Clive, IA (US); Huaxun Ye, Johnston, IA (US)

(73) Assignee: PIONEER HI-BRED INTERNATIONAL, INC., IA (US)

( * ) Notice: Subject to any disclaimer, the term of this patent is extended or adjusted under 35 U.S.C. 154(b) by 134 days.

(21) Appl. No.: 18/249,566

(22) PCT Filed: Oct. 21, 2021

(86) PCT No.: PCT/US2021/071965
§ 371 (c)(1),
(2) Date: Apr. 19, 2023

(87) PCT Pub. No.: WO2022/087616
PCT Pub. Date: Apr. 28, 2022

(65) Prior Publication Data

US 2024/0002877 A1 Jan. 4, 2024

Related U.S. Application Data

(60) Provisional application No. 63/094,763, filed on Oct. 21, 2020, provisional application No. 63/094,774, filed on Oct. 21, 2020.

(51) Int. Cl.
*C12N 15/82* (2006.01)

(52) U.S. Cl.
CPC ..... *C12N 15/8287* (2013.01); *C12N 15/8213* (2013.01)

(58) Field of Classification Search
None
See application file for complete search history.

(56) References Cited

U.S. PATENT DOCUMENTS 4,959,317 A 9/1990 Sauer
5,573,932 A 11/1996 Ellis et al.
(Continued)

FOREIGN PATENT DOCUMENTS

CN 104031936 A 9/2014
EP 2181193 B1 10/2017
(Continued)

OTHER PUBLICATIONS

Rurek et al. "Mitochondrial Biogenesis in Diverse Cauliflower Cultivars under Mild and Severe Drought. Impaired Coordination of Selected Transcript and Proteomic Responses, and Regulation of Various Multifunctional Proteins" 2018 Int. J. Mol. Sci. 19(1130) (29 total pages): doi:10.3390/ijms19041130. (Year: 2018).*
(Continued)

*Primary Examiner* — Matthew R Keogh
*Assistant Examiner* — Rebecca Stephens

(57) ABSTRACT

Parthenogenesis is a natural form of asexual reproduction wherein growth and development of embryos occur without fertilization by sperm. Peptides are used as parthenogenesis factors, specifically comprising polypeptides or polynucleotides encoding gene products for generating doubled haploids or haploid plants from female gametes.

34 Claims, 6 Drawing Sheets

Specification includes a Sequence Listing.

(56) References Cited

U.S. PATENT DOCUMENTS

| | | | |
|---|---|---|---|
| 6,399,855 | B1 | 6/2002 | Beavis |
| 6,800,791 | B1 | 10/2004 | Bailey et al. |
| 7,230,089 | B1 | 6/2007 | Roberts et al. |
| 7,572,635 | B2 | 8/2009 | Armstrong et al. |
| 7,579,529 | B2 | 8/2009 | Gordon-Kamm et al. |
| 8,030,560 | B2 | 10/2011 | Zhao et al. |
| 8,039,686 | B2 | 10/2011 | Podlich et al. |
| 8,321,147 | B2 | 11/2012 | Bink et al. |
| 8,334,429 | B2 | 12/2012 | Ranch et al. |
| 8,574,910 | B2 | 11/2013 | Falco et al. |
| 8,581,036 | B2 | 11/2013 | Samboju et al. |
| 8,859,846 | B2 | 10/2014 | Barton et al. |
| 8,865,971 | B2 | 10/2014 | Zhao et al. |
| 9,040,774 | B2 | 5/2015 | Ivashuta et al. |
| 9,121,032 | B2 | 9/2015 | Williams et al. |
| 10,031,116 | B2 | 7/2018 | Geha et al. |
| 10,102,476 | B2 | 10/2018 | Caraviello et al. |
| 10,280,472 | B2 | 5/2019 | Arnold et al. |
| 10,285,348 | B2 | 5/2019 | Kelliher et al. |
| 10,640,779 | B2 | 5/2020 | Cogan et al. |
| 11,193,131 | B2 | 12/2021 | Campbell et al. |
| 11,330,776 | B2 | 5/2022 | Anand et al. |
| 11,401,524 | B2 | 8/2022 | Armstrong et al. |
| 11,447,786 | B2 | 9/2022 | Fox et al. |
| 11,692,197 | B2 | 7/2023 | Issa et al. |
| 11,732,269 | B2 | 8/2023 | Kerstetter et al. |
| 11,746,354 | B2 | 9/2023 | Clement et al. |
| 12,146,147 | B2 | 11/2024 | Gordon-Kamm et al. |
| 12,543,674 | B2 | 2/2026 | Reinders et al. |
| 2002/0023278 | A1 | 2/2002 | Lyznik et al. |
| 2002/0188965 | A1 | 12/2002 | Zhao et al. |
| 2005/0148765 | A1 | 7/2005 | Cahoon et al. |
| 2005/0257289 | A1 | 11/2005 | Gordon-Kamm et al. |
| 2005/0289673 | A1 | 12/2005 | Armstrong et al. |
| 2007/0271628 | A1 | 11/2007 | Lowe et al. |
| 2008/0216191 | A1 | 9/2008 | Barton et al. |
| 2010/0010056 | A1 | 1/2010 | Rehan et al. |
| 2013/0198893 | A1 | 8/2013 | Zhao et al. |
| 2014/0359836 | A1 | 12/2014 | Wu et al. |
| 2014/0359897 | A1 | 12/2014 | Kelliher et al. |
| 2015/0121561 | A1 | 4/2015 | Koivu |
| 2015/0152430 | A1 | 6/2015 | Albertsen et al. |
| 2015/0247154 | A1 | 9/2015 | Ivashuta et al. |
| 2016/0212956 | A1 | 7/2016 | Boutilier et al. |
| 2016/0304901 | A1 | 10/2016 | Ozias-Akins et al. |
| 2016/0321396 | A1 | 11/2016 | Habier |
| 2017/0121722 | A1 | 5/2017 | Anand et al. |
| 2017/0183677 | A1 | 6/2017 | Gao et al. |
| 2017/0245446 | A1 | 8/2017 | Cooper et al. |
| 2017/0359978 | A1 | 12/2017 | Technow et al. |
| 2018/0094273 | A1 | 4/2018 | Kumar et al. |
| 2018/0216123 | A1 | 8/2018 | Anand et al. |
| 2018/0245090 | A1 | 8/2018 | Campbell et al. |
| 2018/0265877 | A1 | 9/2018 | Anand et al. |
| 2018/0363069 | A1 | 12/2018 | Bakiwala et al. |
| 2020/0263189 | A1 | 8/2020 | Fox et al. |
| 2021/0010012 | A1 | 1/2021 | Gasior et al. |
| 2021/0277422 | A1 | 9/2021 | Cermák |
| 2022/0056461 | A1 | 2/2022 | Kong |
| 2022/0073937 | A1 | 3/2022 | Bauer et al. |
| 2022/0154203 | A1 | 5/2022 | Gordon-Kamm et al. |
| 2022/0235363 | A1 | 7/2022 | Kong et al. |
| 2022/0240467 | A1 | 8/2022 | Reinders et al. |
| 2022/0403400 | A1 | 12/2022 | Chen et al. |
| 2023/0022635 | A1 | 1/2023 | Angacian et al. |
| 2023/0073514 | A1 | 3/2023 | Comadran et al. |
| 2023/0189734 | A1 | 6/2023 | Reinders et al. |
| 2023/0203516 | A1 | 6/2023 | Fox et al. |
| 2023/0270067 | A1 | 8/2023 | Dawe et al. |
| 2023/0407324 | A1 | 12/2023 | Reinders et al. |
| 2025/0101453 | A1 * | 3/2025 | Gordon-Kamm .... C07K 14/415 |

FOREIGN PATENT DOCUMENTS

| | | | | |
|---|---|---|---|---|
| JP | 2017155715 | A | 9/2017 | |
| WO | 9842851 | A1 | 10/1998 | |
| WO | 0017364 | A2 | 3/2000 | |
| WO | 02085104 | A2 | 10/2002 | |
| WO | 2005063990 | A2 | 7/2005 | |
| WO | WO-2005075655 | A2 * | 8/2005 | ......... C12N 15/8287 |
| WO | 2006116876 | A1 | 11/2006 | |
| WO | 2006128707 | A1 | 12/2006 | |
| WO | 2011082318 | A2 | 7/2011 | |
| WO | 2012142311 | A1 | 10/2012 | |
| WO | 2014091255 | A1 | 6/2014 | |
| WO | 2015/061355 | A1 | 4/2015 | |
| WO | 2015043621 | A1 | 4/2015 | |
| WO | 2015048016 | A2 | 4/2015 | |
| WO | 2015167956 | A1 | 11/2015 | |
| WO | 2016146552 | A1 | 9/2016 | |
| WO | 2016149352 | A1 | 9/2016 | |
| WO | 2017004375 | A1 | 1/2017 | |
| WO | 2017017108 | A1 | 2/2017 | |
| WO | 2017070032 | A1 | 4/2017 | |
| WO | 2017074547 | A1 | 5/2017 | |
| WO | 2017078836 | A1 | 5/2017 | |
| WO | 2017153766 | A1 | 9/2017 | |
| WO | 2017155715 | A1 | 9/2017 | |
| WO | 2018015956 | A1 | 1/2018 | |
| WO | 2018015957 | A1 | 1/2018 | |
| WO | 2018098420 | A1 | 5/2018 | |
| WO | 2018183878 | A1 | 10/2018 | |
| WO | 2019/075295 | A1 | 4/2019 | |
| WO | WO-2019104346 | A1 * | 5/2019 | ........... A01H 6/4636 |
| WO | 2019122381 | A2 | 6/2019 | |
| WO | 2019177976 | A1 | 9/2019 | |
| WO | 2019185849 | A1 | 10/2019 | |
| WO | 2020185751 | A1 | 9/2020 | |
| WO | 2020/198408 | A1 | 10/2020 | |
| WO | 2020/214986 | A1 | 10/2020 | |
| WO | 2020239680 | A2 | 12/2020 | |
| WO | 2022087601 | A1 | 4/2022 | |

OTHER PUBLICATIONS

Skinner et al. "Efficient parthenogenesis via egg cell expression of maize Baby Boom 1: a step toward synthetic apomixis" 2023 Plant Physiology 193:2278-2281 (4 total pages)). (Year: 2023).*

Bhowimik P., et al., "Targeted Mutagenesis in Wheat Microspores using CRISPR/Cas9," Scientific Reports, 2018, vol. 8, No. 1, 10 pages.

Pauls K.P., et al., "When Microspores Decide to Become Embryoscellular and Molecular Changes," Canadian Journal of Botany, Jun. 2, 2006, vol. 84, No. 4, pp. 668-678.

MaizeGDB Gene Record p. Zm00001eb315430, 2024, pp. 1-7, Retrieved from, Internet URL: https://www.maizegdb.org/gene_center/gene/Zm00001d020772, Accessed Oct. 5, 2024.

Soni R., et al., "A family of cyclin D Homologs from Plants Differentially Controlled by Growth Regulators and Containing the Conserved Retinoblastoma Protein Interaction Motif," The Plant Cell, 1995, vol. 7, No. 1, pp. 85-103.

Ahmadi B., et al., "In Vitro Androgenesis: Spontaneous Vs. Artificial Genome Doubling and Characterization of Regenerants," Plant Cell Reports, Berlin Heidelberg, Jan. 23, 2020, vol. 39, No. 3, pp. 299-316.

Bilichak A., et al., "Identification of Baby Boom Homolog in Bread Wheat," Agri Gene, Mar. 1, 2018, vol. 7, pp. 43-51.

Black J.B., et al., "Synthetic Transcription Factors for Cell Fate Reprogramming," Current Opinion in Genetics & Development, May 24, 2018, vol. 52, pp. 13-21.

Brooks L., et al., "Microdissection of Shoot Meristem Functional Domains," PLoS Genetics, 2009, vol. 5, No. 5, e1000476.

Cebolla A., et al., "The Mitotic Inhibitor ccs52 is Required for Endoreduplication and Ploidy-Dependent Cell Enlargement in Plants," The EMBO Journal, 1999, vol. 18, No. 16, pp. 4476-4484.

Chaikam V., et al., "Doubled Haploid Technology for Line Development in Maize: Technical Advances and Prospects," Theoretical and Applied Genetics, Springer Berlin Heidelberg, Sep. 25, 2019, vol. 132, pp. 3227-3243.

(56) References Cited

OTHER PUBLICATIONS

Chen J., et al., "Zygotic Genome Activation Occurs Shortly After Fertilization in Maize," The Plant Cell, 2017, vol. 29, No. 9, pp. 2106-2125.

Cheng Y., et al., "Downregulation of Multiple CDK Inhibitor ICK/KRP Genes Upregulates the E2F Pathway and Increases Cell Proliferation, and Organ and Seed Sizes in *Arabidopsis*," The Plant Journal, May 7, 2013, vol. 75, pp. 642-655.

Cockcroft C.E., et al., "Cyclin D Control of Growth Rate in Plants," Nature, Jun. 1, 2000, vol. 405, pp. 575-579.

Copenhaver G.P., et al., "Tetrad Analysis in Higher Plants. A Budding Technology," Plant Physiology, 2000, vol. 124, pp. 7-15.

De Veylder L., et al., "Control of Proliferation, Endoreduplication and Differentiation by the *Arabidopsis* E2Fa-DPa Transcription Factor," The EMBO Journal, 2002, vol. 21, No. 6, pp. 1360-1368.

Derfurth I., et al., "The Cyclin-A CYCA1; 2/TAM is Required for the Meiosis I to Meiosis II Transition and Cooperates with OSD1 for the Prophase to First Meiotic Division Transition," PLoS genetics, 2010, vol. 6, No. 6, e1000989.

Dewitte W., et al., "Altered Cell Cycle Distribution, Hyperplasia, and Inhibited Differentiation in *Arabidopsis* Caused by the D-Type Cyclin CYCD3," The Plant Cell, Jan. 2003, vol. 15, No. 1, pp. 79-92.

Feher A., et al., "Somatic Embryogenesis—Stress-Induced Remodeling of Plant Cell Fate," Biochimica et Biophysica Acta, Gene Regulatory Mechanisms, Amsterdam, NL, Apr. 1, 2015, vol. 1849, No. 4, pp. 385-402, doi: 10.1016/j.bbagrm.2014.07.005, ISSN 1874-9399, XP055702413.

Florez S.L., et al., "Enhanced Somatic Embryogenesis in Theobroma Cacao using the Homologous Baby Boom Transcription factor," BMC Plant Biology, 2015, vol. 15, No. 121, 13 pages.

Gordon-Kamm B., et al., "Using Morphogenic Genes to Improve Recovery and Regeneration of Transgenic Plants," Plants, 2019, vol. 8, No. 2, pp. 1-18.

Gordon-Kamm W., et al., "Stimulation of the Cell Cycle and Maize Transformation by Disruption of the Plant Retinoblastoma Pathway," Proceedings of the National Academy of Sciences, Sep. 3, 2002, vol. 99, No. 18, pp. 11975-11980.

Guo H.H., et al., "Protein Tolerance to Random Amino Acid Change," Proceedings of National Academy of Sciences, USA, Jun. 22, 2004, vol. 101, No. 25, pp. 9205-9210.

Hooghvorst I., et al., "Chromosome Doubling Methods in Doubled Haploid and Haploid Inducer-Mediated Genome-Editing Systems in Major Crops," Plant Cell Reports, Sep. 25, 2020, vol. 40, No. 2, pp. 255-270.

International Preliminary Report on Patentability for International Application No. PCT/US2018/055561, mailed Apr. 23, 2020, 10 Pages.

International Preliminary Report on Patentability for International Application No. PCT/US2020/021844, mailed Sep. 23, 2021, 14 Pages.

International Preliminary Report on Patentability for International Application No. PCT/US2020/028815, mailed Oct. 28, 2021, 11 Pages.

International Preliminary Report on Patentability for International Application No. PCT/US2021/071946, mailed May 4, 2023, 8 Pages.

International Preliminary Report on Patentability for International Application No. PCT/US2021/071965, mailed May 4, 2023, 12 Pages.

International Search Report and Written Opinion for International Application No. PCT/US2018/055561, mailed Mar. 8, 2019, 19 Pages.

International Search Report and Written Opinion for International Application No. PCT/US2020/021844, mailed Aug. 3, 2020, 24 Pages.

International Search Report and Written Opinion for International Application No. PCT/US2020/028815, mailed Aug. 28, 2020, 21 Pages.

International Search Report and Written Opinion for International Application No. PCT/US2021/071946, mailed Feb. 24, 2022, 12 Pages.

Jirawantnotai S., et al., "Role of Cyclins and Cyclin-dependent Kinases in Pluripotent Stem Cells and Their Potential as a Therapeutic Target," In Seminars in Cell & Developmental Biology, 2020, vol. 107, pp. 63-71.

Kelliher T., et al., "One-step Genome Editing of Elite Crop Germplasm During Haploid Induction," Nature Biotechnology, Mar. 2019, vol. 37, pp. 287-292, 14 Pages.

Khanday., "Extended Data Fig. 6: Asexual propagation through seed in rice, Extended Data," Nature, 2018, vol. 565, No. 7737, pp. 1-3.

Khanday I., et al., "A Male-expressed Rice Embryogenic Trigger Redirected for Asexual Propagation Through Seeds," Nature, 2018, vol. 565, No. 7737, pp. 91-95.

Kunitake H., et al., "Isolation and Culture of Asparagus Microspore Protoplasts," Japanese Journal of Breeding, 1993, vol. 43, pp. 231-238.

Kunz C., et al., "Assessment and Improvement of Wheat Microspore Derived Embryo Induction and Regeneration," Journal of Plant Physiology, Feb. 1, 2000, vol. 156, No. 2, pp. 190-196.

Law J.A., et al., "Establishing, Maintaining and Modifying DNA Methylation Patterns in Plants and Animals," Nature Reviews Genetics, Mar. 2010, vol. 11, pp. 204-220.

Li X., et al., "Dissecting Meiotic Recombination based on Tetrad Analysis by Single-Microspore Sequencing in Maize," Nature Communications, Mar. 24, 2015, vol. 6, No. 6648, 9 Pages.

Liu W., et al., "Plant Synthetic Promoters and Transcription Factors," Current Opinion in Biotechnology, Feb. 1, 2016, vol. 37, pp. 36-44.

Lowe K., et al., "Morphogenic Regulators Baby Boom and Wuschel Improve Monocot Transformation", The Plant Cell, American Society of Plant Biologists, US, Sep. 10, 2016, 1998-2015, 1-25 Entire Document, vol. 28, No. 9, 19 Pages, DOI:10.1105/tpc.16.00124, ISSN 1040-4651, XP055318109 [A].

Magyar Z., et al., "The Role of the *Arabidopsis* E2FB Transcription Factor in Regulating Auxin-Dependent Cell Division," The Plant Cell, Sep. 2005, vol. 17, pp. 2527-2541.

Makarevitch I., et al., "Genomic Distribution of Maize Facultative Heterochromatin Marked by Trimethylation of H3K27," The Plant Cell, Mar. 5, 2013, vol. 25, pp. 780-793, 15 Pages.

Murovec J., et al., "Haploids and Doubled Haploids in Plant Breeding," Plant Breeding, 2012, pp. 87-106, 21 pages.

Rodriguez K., et al., "DNA-Dependent Homodimerization, Subcellular Partitioning, and Protein Destabilization Control Wuschel Levels and Spatial Patterning," Proceedings of the National Academy of Sciences of the United States of America, Sep. 26, 2016, vol. 113, No. 41, pp. E6307-E6315.

Schnittger A., et al., "Ectopic D-Type Cyclin Expression Induces Not Only DNA Replication but also Cell Division in *Arabidopsis trichomes*," PNAS, Apr. 30, 2002, vol. 99, No. 9, pp. 6410-6415.

Stieglitz H., "Role of Beta-1, 3-Glucanase in Postmeiotic Microspore Release," Developmental Biology, 1977, vol. 57, pp. 87-97.

Vijverberg K., et al., "Identifying and Engineering Genes for Parthenogenesis in Plants," Frontiers in Plant Science, Feb. 19, 2019, vol. 10, Article 128, 17 Pages.

Vlieghe K., et al., "The DP-E2F-like Gene DEL1 Controls the Endocycle in *Arabidopsis thaliana*," Current Biology, Jan. 11, 2005, vol. 15, pp. 59-63.

Weising K., et al., "Foreign Genes in Plants: Transfer, Structure, Expression and Applications," Annual Review of Genetics, 1988, vol. 22, pp. 421-477, DOI:10.1146/annurev.ge.22.120188.002225, XP055354643.

Xu T., et al., "Cas9-based Tools for Targeted Genome Editing and Transcriptional Control," Applied and Environmental Microbiology, 2014, vol. 80, No. 5, pp. 1544-1552.

Yu Y., et al., "The Tobacco A-Type Cyclin, Nicta; CYCA3;2, at the Nexus of Cell Division and Differentiation," The Plant Cell, Dec. 2003, vol. 15, pp. 2763-2777.

Zheng M. Y., et al., "Production of Doubled Haploids in Wheat (*Triticum aestivum* L.) Through Microspore Embryogenesis Triggered by Inducer Chemicals," Doubled Haploid Production in Crop Plants, Jan. 1, 2003, pp. 83-94.

(56) References Cited

OTHER PUBLICATIONS

Dante R.A., et al., "Cyclin-dependent Kinase Complexes in Developing Maize Endosperm: Evidence for Differential Expression and Functional Specialization," Planta, 2014, vol. 239, pp. 493-509.
Hu X., et al., "Genome-wide Analysis of Cyclins in Maize (*Zea mays*)," Genetics and Molecular Research, 2010, vol. 9, No. 3, pp. 1490-1503.
Quiroz L.F., et al., "Haploid Rhapsody: the Molecular and Cellular Orchestra of in Vivo Haploid Induction in Plants," New Phytologist, 2024, vol. 241, No. 5, pp. 1936-1949.
Kalinowska, Kamila; et al.: "State-of-the-art and novel developments of in vivo haploid technologies", Theoretical and Applied Genetics, Dec. 19, 2018 (Dec. 19, 2018), vol. 132, No. 3, pp. 593-605.
International Search Report and Written Opinion for International Application No. PCT/US2021/071965, mailed on Apr. 13, 2022.
Boniotti M.B., et al., "A Cell-cycle-regulated Kinase Activity Phosphorylates Plant Retinoblastoma Protein and Contains, in *Arabidopsis*, a CDKA/cyclin D Complex," The Plant Journal, Nov. 2001, vol. 28, No. 3, pp. 341-350.
De Veylder L., "The Discovery of Plant D-Type Cyclins," The Plant Cell, Jun. 2019, vol. 31, No. 6, pp. 1194-1195.
Godinez-Palma S.K., et al., "Complexes of D-type Cyclins with CDKs During Maize Germination," Journal of Experimental Botany, Dec. 2013, vol. 64, No. 18, pp. 5661-5671.
He H., et al., "Understanding and Overcoming Hybrid Lethality in Seed and Seedling Stages As Barriers to Hybridization and Gene Flow," Frontiers in Plant Science, Jul. 5, 2023, vol. 14, 1219417, pp. 1-17.
Horvath B.M., et al., "*Arabidopsis* Retinoblastoma Related Directly Regulates DNA Damage Responses Through Functions Beyond Cell Cycle Control," The EMBO Journal, May 2, 2017, vol. 36, No. 9, pp. 1261-1278.
Li X., et al., "The Genetic Control of Leaf and Petal Allometric Variations in *Arabidopsis thaliana*," BMC Plant Biology, Dec. 7, 2020, vol. 20, No. 01, 547, pp. 1-11.
Menges M., et al., "Genomic Organization and Evolutionary Conservation of Plant D-Type Cyclins," Plant Physiology, Dec. 2007, vol. 145, No. 04, pp. 1558-1576.
Sabelli P.A., et al., "RBR3, A Member of the Retinoblastoma-related Family from Maize, Is Regulated by the RBR1E2F Pathway," Proceedings of the National Academy of Sciences of the United States of America, Sep. 13, 2005, vol. 102, No. 37, pp. 13005-13012.
Sanz L., et al., "The *Arabidopsis* D-Type Cyclin CYCD2;1 and the Inhibitor ICK2/KRP2 Modulate Auxin-Induced Lateral Root Formation," The Plant Cell, Feb. 2011, vol. 23, No. 2, pp. 641-660.

* cited by examiner

Haploid induction frequency
0.5
0.4
0.3
0.2
0.1
0.0
PHP94831
PHP92900
RV036694
RV036693
RV036695
RV036687
RV036688
RV036689
RV036690
RV036691

PARTHENOGENESIS FACTORS AND METHODS OF USING SAME

CROSS-REFERENCE TO RELATED APPLICATIONS

This application is a 371 National State Entry of PCT/US21/71965, filed Oct. 21, 2021, which in turn claims priority to U.S. Provisional Application No. 63/094,763, filed Oct. 21, 2020, and U.S. Provisional Application No. 63/094,774, filed Oct. 21, 2020, all of which are hereby incorporated herein by reference in their entireties.

FIELD

The present disclosure relates to the field of plant molecular biology and plant breeding.

REFERENCE TO SEQUENCE LISTING SUBMITTED ELECTRONICALLY

The official copy of the sequence listing is submitted electronically via Patent Center as an ASCII formatted sequence listing with a file named "8527-US-PCT Sequence Listing ST25" created on May 18, 2026 and having a size of 2,841,000 bytes. The sequence listing contained in this ASCII formatted document is part of the specification and is herein incorporated by reference in its entirety.

BACKGROUND OF THE DISCLOSURE

Plant breeding programs identify new cultivars by screening numerous plants to identify individuals with desirable characteristics. Large numbers of progeny from crosses are typically grown and evaluated, ideally across multiple years and environments, to select the plants with the most desirable characteristics.

Typical breeding methods cross two parental plants and the filial 1 hybrid ($F_1$ hybrid), is the first filial ($F_1$) generation. Hybrid vigor in a commercial $F_1$ hybrid is observed when two parental strains, (typically inbreds), from different heterotic groups are intercrossed. Hybrid vigor, the improved or increased function of any biological quality resulting from combining the genetic contributions of its parents, is important to commercial maize seed production. Commercial hybrid performance improvements require continued development of new inbred parental lines.

Maize inbred line development methods may use maternal (gynogenic) doubled haploid production, in which maternal haploid embryos are selected following the fertilization of the ear of a plant resultant from a first-generation cross that has been fertilized with pollen from a so-called "haploid inducer" line. Pollination of a female flower with pollen of a haploid inducer strain results in elevated levels of ovules that contain only the haploid maternal genome, as opposed to inheriting a copy of both the maternal and paternal genome, thus, creating maternal haploid embryos. Ovules within the female flower are the products of meiosis and each maternal ovule is a unique meiotically recombined haploid genome, thereby allowing immature maternal haploid embryos to be isolated and treated using in vitro tissue culture methods that include chromosome doubling treatments to rapidly enable generating maternal doubled haploid recombinant populations. Many of the maize maternal haploid embryos generated by fertilizing a target plant with pollen from a maize haploid inducer line fail to regenerate into a fertile, doubled haploid plant and few, if any, in vitro tissue culture and plantlet regeneration methods propagate multiple, fertile plants from one haploid embryo. Thus, there is a need for improving methods of producing doubled haploid plants from maternal gamete doubled haploids in maize.

Plant breeders would thus also benefit from methods of developing a population of recombinant inbred lines that do not require extensive pollination control methods or the prolonged time required for propagating self-fertilized lines into isogenic states.

SUMMARY

The present disclosure provides method of producing a doubled haploid plant, comprising a) providing to a plant cell an expression cassette comprising i) a parthenogenic morphogenic developmental gene; and ii) a parthenogenesis factor operably linked to an egg cell promoter; b) regenerating a $T_0$ plant containing the expression cassette; c) pollinating the $T_0$ plant with pollen; d) obtaining a haploid embryo from a parthenogenic maternal gametophyte of the $T_0$ plant; and e) regenerating a haploid plant from the haploid embryo. In an aspect, the expression cassette further comprises iii) a genetic chromosome doubling agent operably linked to an egg cell promoter, wherein the parthenogenic maternal gametophyte, having only maternal chromosomes, is diploidized; f) obtaining a diploid embryo from the diploidized parthenogenic maternal gametophyte; and g) regenerating a doubled haploid plant from the diploid embryo. In an aspect, method further comprising h) contacting the haploid embryo with a chromosome doubling agent for a period sufficient to generate a doubled haploid embryo; and i) regenerating a doubled haploid plant from the doubled haploid embryo. In an aspect, the chromosome doubling agent is selected from Table 1. In an aspect, method further comprising k) contacting the haploid plant with a chromosome doubling agent for a period sufficient to generate a doubled haploid plant; In an aspect, the chromosome doubling agent is selected from Table 1. In an aspect, the expression cassette further comprises iv) a means of modulating expression of the parthenogenic morphogenic developmental gene, the parthenogenesis factor, or both the parthenogenic morphogenic developmental gene and the parthenogenesis factor, and/or an endogenous repressor of parthenogenesis to provide a maternal parthenogenic gametophyte of the $T_0$ plant. In an aspect, the expression cassette further comprises v) a CRE recombinase operably linked to a embryogenic promoter, wherein the expression cassette is flanked by loxP recognition sites and wherein the expression cassette is excised. In an aspect, the parthenogenic morphogenic developmental gene comprises a nucleotide sequence encoding a Babyboom (BBM) polypeptide or an Ovule Development Protein 2 (ODP2) polypeptide. In an aspect, the nucleotide sequence encoding the Babyboom (BBM) polypeptide is selected from the group consisting of BBM, BBM2, BMN2, and BMN3 or the Ovule Development Protein 2 (ODP2) polypeptide is ODP2. In an aspect, the parthenogenic morphogenic developmental gene is selected from a) a nucleotide sequence encoding a Babyboom (BBM) polypeptide or an Ovule Development Protein 2 (ODP2) polypeptide selected from any one of SEQ ID NO: 11-20, 162 or 164; or b) a nucleotide sequence encoding a Babyboom (BBM) polypeptide or an Ovule Development Protein 2 (ODP2) polypeptide having at least 95% sequence identity to any one of SEQ ID NO: 11-20, 162 or 164; or c) a nucleotide sequence encoding a Babyboom (BBM) polypeptide or an Ovule Development Protein 2 (ODP2) polypeptide having at least 85% sequence identity to any one of SEQ ID NO: 11-20, 162 or 164. In an aspect, the parthenogenesis factor is selected from Table 13. In an aspect, the means of modulating expression of the parthenogenic morphogenic developmental gene, the parthenogenesis factor, or both the parthenogenic morphogenic developmental gene and the parthenogenesis factor, and/or the endogenous repressor of parthenogenesis is a translational fusion protein that modifies, controls, or stabilizes expression of the parthenogenic morphogenic developmental gene, the parthenogenesis factor, or both the parthenogenic morphogenic developmental gene and the parthenogenesis factor, and/or the endogenous repressor of parthenogenesis, wherein the translation fusion protein up regulates and/or down regulates expression of the parthenogenic morphogenic developmental gene, the parthenogenesis factor, or both the parthenogenic morphogenic developmental gene and the parthenogenesis factor and/or the endogenous repressor of parthenogenesis. In an aspect, the pollen is from a haploid inducer or a non-haploid inducer. In an aspect, the haploid inducer or the non-haploid inducer comprises a marker gene. In an aspect, the marker gene is selected from a selectable marker, a reporter gene, a visible endogenous morphological marker, and combinations thereof. In an aspect, the selectable marker is selected from the group consisting of GUS, PMI, PAT, and combinations thereof. In an aspect, the reporter gene is selected from the group consisting of GFP, RFP, CFP, and combinations thereof. In an aspect, the visible endogenous morphological marker is selected from the group consisting of B1, R-nj, R1-scm, anthocyanin pigments, and combinations thereof. In an aspect, obtaining the diploid embryo from the diploidized parthenogenic maternal gametophyte further comprises obtaining a doubled haploid embryo from the diploidized parthenogenic $T_0$ plant, wherein the doubled haploid embryo lacks the marker gene. In an aspect, obtaining the diploid embryo from the diploidized parthenogenic maternal gametophyte further comprises obtaining a mature seed having a diploidized maternal embryo lacking the marker gene and germinating the mature seed to obtain a doubled haploid plant. In an aspect, the genetic chromosome doubling agent comprises a nucleotide sequence encoding a cyclin gene family member. In an aspect, the cyclin gene family member is selected from Table 18 or is Dz470 (SEQ ID NO: 110). In an aspect, the egg cell promoter is selected from Table 11 or Table 12. In an aspect, the egg cell promoter further comprises an EME selected from Table 9. In an aspect, the egg cell promoter further comprises an enhancer selected from Table 10. In an aspect, the expression cassette further comprises a genome modification component. In an aspect, the gene editing component uses a DNA modification enzyme that is a site-directed nuclease selected from the group comprising meganucleases (MNs), zinc-finger nucleases (ZFN), transcription-activator like effector nucleases (TALENs), Cas9 nuclease, Cas alpha nuclease, Cpf1 nuclease, dCas9-FokI, dCpf1-FokI, chimeric Cas9-cytidine deaminase, chimeric Cas9 adenine deaminase, chimeric FEN1-Fok1, Mega-TALs, a nickase Cas9 (nCas9), chimeric dCas9 non-FokI nuclease, and dCpf1-non-FokI nuclease.

The present disclosure provides a method of producing a genome edited doubled haploid plant, comprising a) providing to a maternal gametophyte an expression cassette comprising i) a parthenogenic morphogenic developmental gene; and ii) a parthenogenesis factor operably linked to an egg cell promoter; b) regenerating a $T_0$ plant containing the expression cassette; c) pollinating the $T_0$ plant with pollen; d) obtaining a haploid embryo from a parthenogenic maternal gametophyte of the $T_0$ plant; and e) regenerating a haploid plant from the haploid embryo. The present disclosure provides the expression cassette further comprises iii) a genetic chromosome doubling agent operably linked to an egg cell promoter, wherein the parthenogenic maternal gametophyte, having only maternal chromosomes, is diploidized; f) obtaining a diploid embryo from the diploidized parthenogenic maternal gametophyte; and g) regenerating a doubled haploid plant from the diploid embryo. In an aspect, the method further comprising h) contacting the haploid embryo with a chromosome doubling agent for a period sufficient to generate a doubled haploid embryo; and i) regenerating a doubled haploid plant from the doubled haploid embryo. In an aspect, the chromosome doubling agent is selected from Table 1. In an aspect, the method further comprising k) contacting the haploid plant with a chromosome doubling agent for a period sufficient to generate a doubled haploid plant. In an aspect, the chromosome doubling agent is selected from Table 1. In an aspect, the expression cassette further comprises iv) a means of modulating expression of the parthenogenic morphogenic developmental gene, the parthenogenesis factor, or both the parthenogenic morphogenic developmental gene and the parthenogenesis factor, and/or an endogenous repressor of parthenogenesis to provide a maternal parthenogenic gametophyte of the $T_0$ plant. In an aspect, the expression cassette further comprises v) a genome modification component. In an aspect, the expression cassette further comprises vi) a CRE recombinase operably linked to a embryogenic promoter, wherein the expression cassette is flanked by loxP recognition sites and wherein the expression cassette is excised. In an aspect, the parthenogenic morphogenic developmental gene comprises a nucleotide sequence encoding a Babyboom (BBM) polypeptide or an Ovule Development Protein 2 (ODP2) polypeptide. In an aspect, the nucleotide sequence encoding the Babyboom (BBM) polypeptide is selected from the group consisting of BBM, BBM2, BMN2, and BMN3 or the Ovule Development Protein 2 (ODP2) polypeptide is ODP2. In an aspect, the parthenogenic morphogenic developmental gene is selected from a) a nucleotide sequence encoding a Babyboom (BBM) polypeptide or an Ovule Development Protein 2 (ODP2) polypeptide selected from any one of SEQ ID NO: 11-20, 162 or 164; or b) a nucleotide sequence encoding a Babyboom (BBM) polypeptide or an Ovule Development Protein 2 (ODP2) polypeptide having at least 95% sequence identity to any one of SEQ ID NO: 11-20, 162 or 164; or c) a nucleotide sequence encoding a Babyboom (BBM) polypeptide or an Ovule Development Protein 2 (ODP2) polypeptide having at least 85% sequence identity to any one of SEQ ID NO: 11-20, 162 or 164 In an aspect, the parthenogenesis factor is selected from Table 13. In an aspect, means of modulating expression of the parthenogenic morphogenic developmental gene, the parthenogenesis factor, or both the parthenogenic morphogenic developmental gene and the parthenogenesis factor, and/or the endogenous repressor of parthenogenesis is a translational fusion protein that modifies, controls, or stabilizes expression of the parthenogenic morphogenic developmental gene, the parthenogenesis factor, or both the parthenogenic morphogenic developmental gene and the parthenogenesis factor, and/or the endogenous repressor of parthenogenesis, wherein the translation fusion protein up regulates and/or down regulates expression of the parthenogenic morphogenic developmental gene, the parthenogenesis factor, or both the parthenogenic morphogenic developmental gene and the parthenogenesis factor and/or the endogenous repressor of parthenogenesis. In an aspect, the pollen is from a haploid inducer or a non-haploid inducer. In an aspect, the haploid inducer or the non-haploid inducer comprises a marker gene. In an aspect, the marker gene is selected from a selectable marker, a reporter gene, a visible endogenous morphological marker, and combinations thereof. In an aspect, the selectable marker is selected from the group consisting of GUS, PMI, PAT, and combinations thereof. In an aspect, the reporter gene is selected from the group consisting of GFP, RFP, CFP, and combinations thereof. In an aspect, the visible endogenous morphological marker is selected from the group consisting of B1, R-nj, R1-scm, anthocyanin pigments, and combinations thereof. In an aspect, wherein obtaining the diploid embryo from the diploidized parthenogenic maternal gametophyte further comprises obtaining a doubled haploid embryo from the diploidized parthenogenic $T_0$ plant, wherein the doubled haploid embryo lacks the marker gene. In an aspect, obtaining the diploid embryo from the diploidized parthenogenic maternal gametophyte further comprises obtaining a mature seed having a diploidized maternal embryo lacking the marker gene and germinating the mature seed to obtain a doubled haploid plant. In an aspect, the genetic chromosome doubling agent comprises a nucleotide sequence encoding a cyclin gene family member. In an aspect, the cyclin gene family member is selected from Table 18 or is Dz470 (SEQ ID NO: 110). In an aspect, the egg cell promoter is selected from Table 11 or Table 12. In an aspect, the egg cell promoter further comprises an EME selected from Table 9. In an aspect, the egg cell promoter further comprises an enhancer selected from Table 10. In an aspect, gene editing component uses a DNA modification enzyme that is a site-directed nuclease selected from the group comprising meganucleases (MNs), zinc-finger nucleases (ZFN), transcription-activator like effector nucleases (TALENs), Cas9 nuclease, Cas alpha nuclease, Cpf1 nuclease, dCas9-FokI, dCpf1-FokI, chimeric Cas9-cytidine deaminase, chimeric Cas9 adenine deaminase, chimeric FEN1-Fok1, Mega-TALs, a nickase Cas9 (nCas9), chimeric dCas9 non-FokI nuclease, and dCpf1-non-FokI nuclease.

The present disclosure provides a method of producing a doubled haploid plant, comprising a) providing to a plant cell an expression cassette comprising i) a parthenogenic morphogenic developmental gene or a parthenogenesis factor operably linked to an egg cell promoter; and ii) a genetic chromosome doubling agent operably linked to an egg cell promoter; b) regenerating a $T_0$ plant containing the expression cassette, wherein a maternal gametophyte of the $T_0$ plant is rendered parthenogenic by the parthenogenic morphogenic developmental gene or the parthenogenesis factor to provide a maternal parthenogenic gametophyte and wherein the maternal parthenogenic gametophyte having only maternal chromosomes, is diploidized; c) pollinating the $T_0$ plant with pollen; d) obtaining a diploid embryo from the diploidized parthenogenic maternal gametophyte the $T_0$ plant; and e) regenerating a double haploid plant from the diploid embryo. In an aspect, the expression cassette further comprises iii) a means of modulating expression of the parthenogenic morphogenic developmental gene or the parthenogenesis factor, and/or an endogenous repressor of parthenogenesis, wherein the maternal gametophyte is rendered parthenogenic. In an aspect, the expression cassette further comprises iv) a CRE recombinase operably linked to a embryogenic promoter, wherein the expression cassette is flanked by loxP recognition sites and wherein the expression cassette is excised. In an aspect, the parthenogenic morphogenic developmental gene comprises a nucleotide sequence encoding a Babyboom (BBM) polypeptide or an Ovule Development Protein 2 (ODP2) polypeptide. In an aspect, the nucleotide sequence encoding the Babyboom (BBM) polypeptide is selected from the group consisting of BBM, BBM2, BMN2, and BMN3 or the Ovule Development Protein 2 (ODP2) polypeptide is ODP2. In an aspect, the parthenogenic morphogenic developmental gene is selected from a) a nucleotide sequence encoding a Babyboom (BBM) polypeptide or an Ovule Development Protein 2 (ODP2) polypeptide selected from any one of SEQ ID NO: 11-20, 162 or 164; or b) a nucleotide sequence encoding a Babyboom (BBM) polypeptide or an Ovule Development Protein 2 (ODP2) polypeptide having at least 95% sequence identity to any one of SEQ ID NO: 11-20, 162 or 164; or c) a nucleotide sequence encoding a Babyboom (BBM) polypeptide or an Ovule Development Protein 2 (ODP2) polypeptide having at least 85% sequence identity to any one of SEQ ID NO: 11-20, 162 or 164. In an aspect, the parthenogenesis factor is selected from Table 13. In an aspect, the means of modulating expression of the parthenogenic morphogenic developmental gene or the parthenogenesis factor and/or the endogenous repressor of parthenogenesis is a translational fusion protein that modifies, controls, or stabilizes expression of the parthenogenic morphogenic developmental gene or the parthenogenesis factor, wherein the translation fusion protein up regulates and/or down regulates expression of the parthenogenic morphogenic developmental gene or the parthenogenesis factor and/or the endogenous repressor of parthenogenesis. In an aspect, the pollen is from a haploid inducer or a non-haploid inducer. In an aspect, the haploid inducer or the non-haploid inducer comprises a marker gene. In an aspect, the marker gene is selected from a selectable marker, a reporter gene, a visible endogenous morphological marker, and combinations thereof. In an aspect, the selectable marker is selected from the group consisting of GUS, PMI, PAT, and combinations thereof. In an aspect, the reporter gene is selected from the group consisting of GFP, RFP, CFP, and combinations thereof. In an aspect, the visible endogenous morphological marker is selected from the group consisting of B1, R-nj, R1-scm, anthocyanin pigments, and combinations thereof. In an aspect, obtaining the diploid embryo from the diploidized parthenogenic maternal gametophyte further comprises obtaining a doubled haploid embryo from the diploidized parthenogenic $T_0$ plant, wherein the doubled haploid embryo lacks the marker gene. In an aspect, obtaining the diploid embryo from the diploidized parthenogenic maternal gametophyte further comprises obtaining a mature seed having a diploidized maternal embryo lacking the marker gene and germinating the mature seed to obtain a doubled haploid plant. In an aspect, the genetic chromosome doubling agent comprises a nucleotide sequence encoding a cyclin gene family member. In an aspect, the cyclin gene family member is selected from Table 18 or is Dz470 (SEQ ID NO: 110). In an aspect, the egg cell promoter is selected from Table 11 or Table 12. In an aspect, the egg cell promoter further comprises an EME selected from Table 9. In an aspect, the egg cell promoter further comprises an enhancer selected from Table 10. In an aspect, the expression cassette further comprises a genome modification component. In an aspect, the gene editing component uses a DNA modification enzyme that is a site-directed nuclease selected from the group comprising meganucleases (MNs), zinc-finger nucleases (ZFN), transcription-activator like effector nucleases (TALENs), Cas9 nuclease, Cas alpha nuclease, Cpf1 nuclease, dCas9-FokI, dCpf1-FokI, chimeric Cas9-cytidine deaminase, chimeric Cas9 adenine deaminase, chimeric FEN1-Fok1, Mega-TALs, a nickase Cas9 (nCas9), chimeric dCas9 non-FokI nuclease, and dCpf1-non-FokI nuclease.

The present disclosure provides a method of producing a doubled haploid plant, comprising a) providing to a plant cell an expression cassette comprising i) a parthenogenic morphogenic developmental gene; and ii) a translational fusion protein operably linked to an egg cell promoter; b) regenerating a $T_0$ plant containing the expression cassette wherein a maternal gametophyte of the $T_0$ plant is rendered parthenogenic by the parthenogenic morphogenic developmental gene and/or the translational fusion protein to provide a maternal parthenogenic gametophyte; c) pollinating the $T_0$ plant with pollen; d) obtaining a haploid embryo from the parthenogenic maternal gametophyte; and e) regenerating a haploid plant from the haploid embryo. In an aspect, the expression cassette further comprises iii) a genetic chromosome doubling agent operably linked to an egg cell promoter, wherein the maternal parthenogenic gametophyte, having only maternal chromosomes, is diploidized; f) obtaining a diploid embryo from the diploidized parthenogenic maternal gametophyte; and g) regenerating a doubled haploid plant from the diploid embryo. In an aspect, the method further comprising h) contacting the haploid embryo with a chromosome doubling agent for a period sufficient to generate a doubled haploid embryo; and j) regenerating a doubled haploid plant from the doubled haploid embryo. In an aspect, the chromosome doubling agent is selected from Table 1. In an aspect, the method further comprising k) contacting the haploid plant with a chromosome doubling agent for a period sufficient to generate a doubled haploid plant. In an aspect, the chromosome doubling agent is selected from Table 1. In an aspect, the expression cassette further comprises v) a CRE recombinase operably linked to a embryogenic promoter, wherein the expression cassette is flanked by loxP recognition sites and wherein the expression cassette is excised. In an aspect, the translational fusion protein modulates the expression of the parthenogenic morphogenic developmental gene by inhibiting an endogenous repressor of parthenogenesis. In an aspect, the parthenogenic morphogenic developmental gene comprises a nucleotide sequence encoding a Babyboom (BBM) polypeptide or an Ovule Development Protein 2 (ODP2) polypeptide. In an aspect, the nucleotide sequence encoding the Babyboom (BBM) polypeptide is selected from the group consisting of BBM, BBM2, BMN2, and BMN3 or the Ovule Development Protein 2 (ODP2) polypeptide is ODP2. In an aspect, the parthenogenic morphogenic developmental gene is selected from a) a nucleotide sequence encoding a Babyboom (BBM) polypeptide or an Ovule Development Protein 2 (ODP2) polypeptide selected from any one of SEQ ID NO: 11-20, 162 or 164; or b) a nucleotide sequence encoding a Babyboom (BBM) polypeptide or an Ovule Development Protein 2 (ODP2) polypeptide having at least 95% sequence identity to any one of SEQ ID NO: 11-20, 162 or 164; or c) a nucleotide sequence encoding a Babyboom (BBM) polypeptide or an Ovule Development Protein 2 (ODP2) polypeptide having at least 85% sequence identity to any one of SEQ ID NO: 11-20, 162 or 164. In an aspect, the repressor of the parthenogenic morphogenic developmental gene is selected from Table 13. In an aspect, the pollen is from a haploid inducer or a non-haploid inducer. In an aspect, the haploid inducer or the non-haploid inducer comprises a marker gene. In an aspect, the marker gene is selected from a selectable marker, a reporter gene, a visible endogenous morphological marker, and combinations thereof. In an aspect, the selectable marker is selected from the group consisting of GUS, PMI, PAT, and combinations thereof. In an aspect, the reporter gene is selected from the group consisting of GFP, RFP, CFP, and combinations thereof. In an aspect, the visible endogenous morphological marker is selected from the group consisting of B1, R-nj, R1-scm, anthocyanin pigments, and combinations thereof. In an aspect, obtaining the diploid embryo from the diploidized parthenogenic maternal gametophyte further comprises obtaining a doubled haploid embryo from the diploidized parthenogenic $T_0$ plant, wherein the doubled haploid embryo lacks the marker gene. In an aspect, obtaining the diploid embryo from the diploidized parthenogenic maternal gametophyte further comprises obtaining a mature seed having a diploidized maternal embryo lacking the marker gene and germinating the mature seed to obtain a doubled haploid plant. In an aspect, the genetic chromosome doubling agent comprises a nucleotide sequence encoding a cyclin gene family member. In an aspect, the cyclin gene family member is selected from Table 18 or is Dz470 (SEQ ID NO: 110). In an aspect, the egg cell promoter is selected from Table 11 or Table 12. In an aspect, the egg cell promoter further comprises an EME selected from Table 9. In an aspect, the egg cell promoter further comprises an enhancer selected from Table 10. In an aspect, the expression cassette further comprises a genome modification component. In an aspect, the gene editing component uses a DNA modification enzyme that is a site-directed nuclease selected from the group comprising meganucleases (MNs), zinc-finger nucleases (ZFN), transcription-activator like effector nucleases (TALENs), Cas9 nuclease, Cas alpha nuclease, Cpf1 nuclease, dCas9-FokI, dCpf1-FokI, chimeric Cas9-cytidine deaminase, chimeric Cas9 adenine deaminase, chimeric FEN1-Fok1, Mega-TALs, a nickase Cas9 (nCas9), chimeric dCas9 non-FokI nuclease, and dCpf1-non-FokI nuclease.

The present disclosure provides a method of genome editing through haploid induction, the method comprising providing one or more guide RNAs through a haploid inducer line, wherein the haploid inducer line does not comprise a stably integrated guide RNA binding protein and crossing the haploid inducer line with a second plant to produce haploid maternal cell, wherein the maternal cell contains the guide RNA binding protein capable of forming a complex with the one or more guide RNAs and introducing one or more targeted genomic changes in the genome of the maternal cell. In an aspect, the haploid inducer line and the second plant are of different plant species capable of wide hybridization or outcross. In an aspect, the guide RNA binding protein is provided exogenously through an in vitro step. In an aspect, the guide RNA binding protein is provided through a stably integrated plant line by crossing.

The present disclosure provides a plant cell comprising paternally provided guide RNAs and maternally derived guide RNA binding protein, wherein the guide RNAs are provided through a haploid inducer line. In an aspect, the plant cell is doubled through chromosome doubling. In an aspect, the guide RNAs are multiplexed to target multiple sites in a genome of the plant cell.

The present disclosure provides a method of producing a clonal apomictic plant from one or more gametophytic or sporophytic cells in a flowering plant in the absence of egg cell fertilization comprising a) transforming a plant cell with an expression cassette comprising a polynucleotide encoding at least one parthenogenesis factor having at least 85% sequence identity to at least one polypeptide listed in Table 13, wherein the activity of the at least one parthenogenesis factor polypeptide is provided to a gametophytic or sporophytic cell of the transformed plant cell in the absence of egg cell fertilization; b) developing an embryo from the gametophytic or sporophytic cell; and c) deriving a progeny plant from the gametophytic or sporophytic cell wherein the progeny plant contains the chromosomes from the transformed plant cell thereby achieving propagation of a flowering plant in the absence of egg cell fertilization. In an aspect, the polynucleotide is operably linked to a regulatory element capable of regulating gene expression in the sporogenic tissue, inner integument, nucellus, and/or megasporocyte. In an aspect, the embryo is formed from an unreduced plant cell. In an aspect, the unreduced plant cell is an egg cell. In an aspect, the unreduced plant cell is formed from a somatic cell.

The present disclosure provides a method of producing a clonal apomictic plant from one or more gametophytic or sporophytic cells in a flowering plant in the absence of egg cell fertilization comprising a) transforming a plant cell with an expression cassette comprising i) a first polynucleotide encoding a first translational fusion protein operably linked to a sporogenic promoter, wherein a gametophytic or sporophytic cell is rendered parthenogenic by a modulating activity of the first translational fusion protein on an endogenous parthenogenic morphogenic developmental gene; and/or ii) a second polynucleotide encoding a second translational fusion protein operably linked to a sporogenic promoter, wherein a gametophytic or sporophytic cell is rendered parthenogenic by a modulating activity of the second translational fusion protein on an endogenous repressor of parthenogenesis and/or a gene that confers meiosis; b) regenerating a $T_0$ plant, wherein the $T_0$ plant provides a non-reduced, non-recombined gamete; c) obtaining an embryo from the non-reduced, non-recombined gamete in the absence of egg cell fertilization; and d) obtaining a progeny plant from and the embryo. In an aspect, the modulating activity comprises modifying, controlling, or stabilizing expression of the endogenous parthenogenic morphogenic developmental gene, and/or the endogenous repressor of parthenogenesis, and/or the gene that confers meiosis, wherein the translation fusion protein up regulates and/or down regulates expression of the parthenogenic morphogenic developmental gene, and/or the endogenous repressor of parthenogenesis, and/or the gene that confers meiosis.

The present disclosure provides a method of producing an apomictic plant comprising a) transforming a plant cell with i) a first expression cassette comprising a polynucleotide encoding a first gene product protein that activates parthenogenesis, and ii) a second expression cassette comprising a polynucleotide encoding a second gene product that inhibits repressors of parthenogenesis and/or represses genes required for meiosis; b) regenerating a $T_0$ plant, wherein megasporogenesis of the $T_0$ plant provides a maternal gametophyte having a non-reduced (2n), non-recombined genome that is rendered parthenogenic during megasporogenesis; c) obtaining a parthenogenic, non-reduced (2n), non-recombined embryo from the maternal gametophyte of the $T_0$ plant; and d) obtaining a clonal, non-reduced (2n), non-recombined plant from the embryo. In an aspect, the gene product protein that activates parthenogenesis comprises a) an ODP2 peptide; or b) a translational fusion protein, wherein the fusion protein comprises i) a recognition domain that confers binding specificity to a genomic target site; and ii) a regulatory domain that confers increased regulatory activity at a genomic target site. In an aspect, the polynucleotide encoding a first gene product protein that activates parthenogenesis is selected from a) a nucleotide sequence encoding a Babyboom (BBM) polypeptide or an Ovule Development Protein 2 (ODP2) polypeptide selected from any one of SEQ ID NO: 11-20, 162 or 164; or b) a nucleotide sequence encoding a Babyboom (BBM) polypeptide or an Ovule Development Protein 2 (ODP2) polypeptide having at least 95% sequence identity to any one of SEQ ID NO: 11-20, 162 or 164; or c) a nucleotide sequence encoding a Babyboom (BBM) polypeptide or an Ovule Development Protein 2 (ODP2) polypeptide having at least 85% sequence identity to any one of SEQ ID NO: 11-20, 162 or 164. In an aspect, the translational fusion protein has a recognition domain comprising a Cas endonuclease. In an aspect, the Cas endonuclease is a Cas-alpha endonuclease selected from Table 21. In an aspect, the translational fusion protein has a regulatory domain comprising a transcriptional activator and/or chromatin modifying domain. In an aspect, the transcriptional activator and/or chromatin modifying domain is a sequence selected from Table 19. In an aspect, the plant cell comprises a loss of function at a locus encoding a gene product that inhibits parthenogenesis and/or that is a gene product required for meiosis. In an aspect, the second expression cassette comprising the polynucleotide encoding the second gene product that inhibits repressors of parthenogenesis and/or represses genes required for meiosis comprises a translation fusion protein comprising a) a recognition domain that confers binding specificity to a genomic target site; and b) a regulatory domain that confers decreased regulatory activity at a genomic target site. In an aspect, a loss of function at a locus encoding a repressor of parthenogenesis is provided by obtaining a mutation in a locus encoding a gene selected from Table 13. In an aspect, a loss of function mutation at a locus encoding a gene product required for meiosis is provided by a) a mutation in a locus encoding an endogenous Spo11 gene; b) a mutation in a locus encoding an endogenous Rec8 gene; c) a mutation in a locus encoding an endogenous OSD1-1A gene; d) a mutation in a locus encoding an endogenous OSD1-3A gene; and f) combinations of the foregoing. In an aspect, the loss of function mutation comprises a MiMe genotype exhibiting a MiMe phenotype. In an aspect, the translational fusion protein has a recognition domain comprising a Cas endonuclease. In an aspect, the Cas endonuclease is a Cas-alpha endonuclease selected from Table 21. In an aspect, the translational fusion protein has a regulatory domain comprising a transcriptional repressor and or chromatin modifying domain. In an aspect, the transcriptional repressor is a repressor selected from Table 22. In an aspect, the chromatin modifying domain contains a SET domain selected from Table 24. In an aspect, the regenerated $T_0$ plant is fertilized with pollen from a pollen donor. In an aspect, the pollen donor has a paternal marker gene. In an aspect, the paternal marker gene is selected from a selectable marker, a reporter gene, a visible endogenous morphological marker, and combinations thereof. In an aspect, the selectable marker is selected from the group consisting of GUS, PMI, PAT, and combinations thereof. In an aspect, the reporter gene is selected from the group consisting of GFP, RFP, CFP, and combinations thereof. In an aspect, the visible endogenous morphological marker is selected from the group consisting of B1, R-nj, R1-scm, anthocyanin pigments, and combinations thereof. In an aspect, the parthenogenic, non-reduced (2n), non-recombined embryo lacks the marker gene. In an aspect, the parthenogenic, non-reduced (2n), non-recombined embryo is selected using a) a manual selection method; b) an automated selection method; and c) combinations of the foregoing. In an aspect, the pollen has a morphological marker. In an aspect, the pollen has a mutation conferring a female sterile phenotype.

The present disclosure provides a method of producing a triploid endosperm comprising pollinating an apomictic plant with pollen from a pollen donor. In an aspect, the pollen donor has a paternal marker gene. In an aspect, the paternal marker gene is selected from a selectable marker, a reporter gene, a visible endogenous morphological marker, and combinations thereof. In an aspect, the selectable marker is selected from the group consisting of GUS, PMI, PAT, and combinations thereof. In an aspect, the reporter gene is selected from the group consisting of GFP, RFP, CFP, and combinations thereof. In an aspect, the visible endogenous morphological marker is selected from the group consisting of B1, R-nj, R1-scm, anthocyanin pigments, and combinations thereof. In an aspect, the pollen has a morphological marker. In an aspect, the pollen has a mutation conferring a female sterile phenotype.

DETAILED DESCRIPTION

Figure 1:
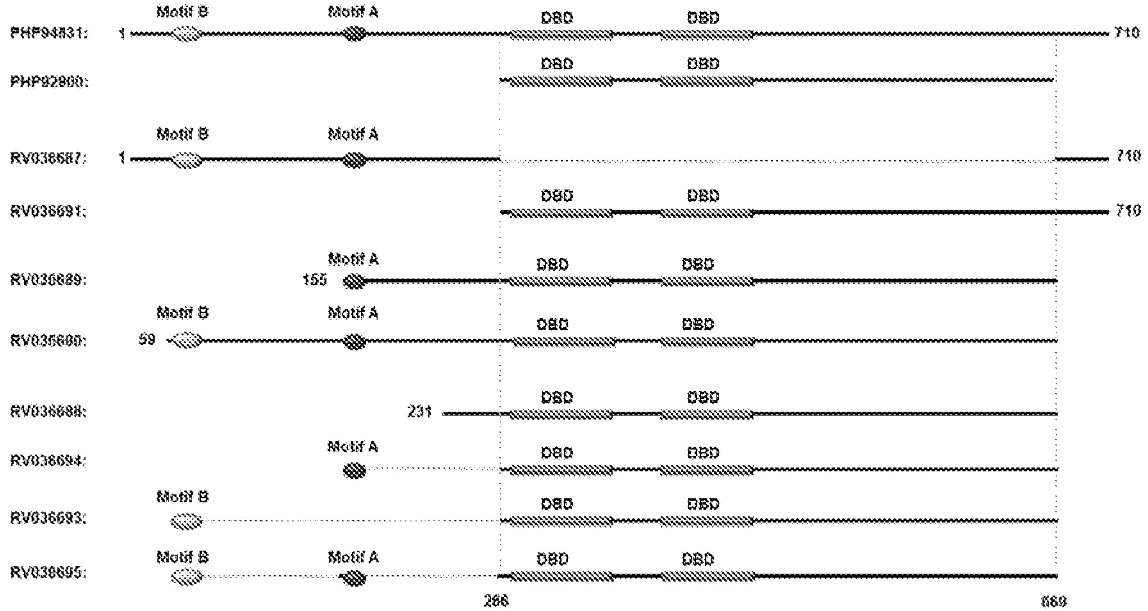
FIG. 1 shows haploid parthenogenesis plasmids (PHP94831, PHP92900, RV036687, RV036691, RV036689, RV036690, RV036688, RV036694, RV036693, and RV036695) used in the present disclosure. The ZM-ODP2 (*Zea mays* Ovule Development Protein 2) peptide encoded by each plasmid (PHP) is graphically represented. Annotations relative to the full length ZM-ODP2 peptide encoded by PHP94831 are shown. In particular, the ZM-ODP2 peptide encoded by PHP94831 is labelled at the first amino acid residue (1) and the last amino acid residue (710). In addition, the encoded domains for motif B (Ala60-Gal69) and motif A (Ile156-Pro171), as well as, the two conserved APETALA2 (AP2) DNA binding domains (DBD) are labeled. Also shown are peptide fragments with boundaries at position 266 (vertical dashed line) and at position 669 (vertical dashed line). Translational fusions of various peptide fragments having a linker sequence (horizontal dashed line) are shown for each plasmid encoding a synthetic peptide (see RV036687, RV036694, RV036693, and RV036695). Plasmids encoding various peptide fragments having unique N-terminus starting positions are labelled with a number corresponding to that residue position in the full length ZM-ODP2 peptide (see RV036687 (position 1), RV036689 (position 155), RV036690 (position 59), RV036688 (position 231)).

The disclosures herein are described more fully hereinafter with reference to the accompanying figures, in which some, but not all possible aspects are shown. Indeed, disclosures may be embodied in many different forms and should not be construed as limited to the aspects set forth herein; rather, these aspects are provided so that this disclosure will satisfy applicable legal requirements.

Many modifications and other aspects disclosed herein will come to mind to one skilled in the art to which the disclosed methods and compositions pertain having the benefit of the teachings presented in the following descriptions and the associated figures. Therefore, it is to be understood that the disclosures are not to be limited to the specific aspects disclosed and that modifications and other aspects are intended to be included within the scope of the appended claims. Although specific terms are employed herein, they are used in a generic and descriptive sense only and not for purposes of limitation.

It is also to be understood that the terminology used herein is for the purpose of describing particular aspects only and is not intended to be limiting. As used in the specification and in the claims, the term "comprising" can include the aspect of "consisting of" Unless defined otherwise, all technical and scientific terms used herein have the same meaning as commonly understood by one of ordinary skill in the art to which the disclosed methods and compositions belong. In this specification and in the claims which follow, reference is made to a number of terms which shall be defined herein.

As used herein the singular forms "a", "an", and "the" include plural referents unless the context clearly dictates otherwise. Thus, for example, reference to "a cell" includes a plurality of such cells and reference to "the protein" includes reference to one or more proteins and equivalents thereof known to those skilled in the art, and so forth. All technical and scientific terms used herein have the same meaning as commonly understood to one of ordinary skill in the art to which this disclosure belongs unless clearly indicated otherwise.

All patents, publications and patent applications mentioned in the specification are indicative of the level of those skilled in the art to which this disclosure pertains. All patents, publications and patent applications are herein incorporated by reference in the entirety to the same extent as if each individual patent, publication or patent application was specifically and individually indicated to be incorporated by reference in its entirety.

In plants, germ line cells (germline) provide the transgenerational inheritance of genetic information in each subsequent generation by producing spore mother cells during sporogenesis. For example, sporogenesis provides the megaspore mother cell that develops the female gametes, the egg cell and central cell that give rise to the embryo and endosperm, respectively; or the microspore mother cell that develops the male gamete, giving rise to four haploid microspores, wherein each microspore further develops into a mature pollen grain. A key aspect for the unique role of germline cells is providing the genetic information a future offspring receives, wherein half of the genetic contribution is from the female gamete and half of the genetic contribution is from the male gamete. Fertilization of the egg cell with one sperm cell forms a diploid zygote, while a second sperm cells fuses with the two polar nuclei of the central cell to form a triploid endosperm. The endosperm is a terminally nourishing tissue for the embryo yet does not contribute to the germline. After fertilization, the zygote gives rise to an embryo, a process referred to as zygotic embryogenesis that is characteristic of sexual reproduction. A newly formed embryo undergoing such an embryogenesis developmental program comprising an underlying regulatory program affected by genetic determinants and epigenetic reprogramming leading from an embryogenic cell state to the acquisition of a differentiated cell fate, or cell fates, ultimately giving rise to a plant with all differentiated tissues thereof.

Parthenogenesis is a natural form of asexual reproduction wherein growth and development of female gametes (embryos) occur without fertilization by sperm. The female gamete produced parthenogenetically may be either haploid or diploid.

The methods of the present disclosure can alter such developmental programs of plant sexual and asexual reproduction described above. Such methods are valuable as plant reproduction methods for agricultural use. The present disclosure provides methods using molecular mechanisms underlying parthenogenesis inducing technologies that are useful for agricultural use and crop improvement.

Parthenogenesis induction refers to a method of providing a stimulus to a cell that improves levels of maternal haploid induction. Apetala2 (AP2) variant peptides are used as parthenogenesis factors (PFs), specifically comprising polypeptides or polynucleotides encoding gene products for generating doubled haploids or haploid plants from female gametes. Maize female gametophytes contacted with a parthenogenesis factor gene product results in improved levels of maternal haploid induction. Specifically, the gametes of a maize plant develop into a haploid plant when the plant is transformed with a genetic construct including regulatory elements and structural genes capable of altering the cellular fate of the plant cells. Further, the gametes of a maize plant can develop into a diploid plant when the plant is transformed with a genetic construct including regulatory elements and structural genes capable of altering cellular fate and cell cycle regulation of plant cells. In the methods of the present disclosure, parthenogenesis factor proteins including cell cycle regulating proteins expressed from a genetic construct are used for altering cell fate and ploidy levels in vivo.

As used herein, a "parthenogenesis factor" or "PF" includes, but is not limited to, gene products that improve levels of maternal haploid induction and asexual reproduction wherein growth and development of female gametes (embryos) occur without fertilization by sperm when expressed in egg cells.

As used herein, a "parthenogenesis treatment" is any of the treatments disclosed herein that elicits an parthenogenic response in the contacted cell.

The present disclosure comprises methods for inducing parthenogenesis to produce maternal haploids. These parthenogenesis factors can be used in combination with a morphogenic developmental gene and/or embryogenesis factor.

As used herein, "asexual reproduction" means reproduction without the fusion of gametes.

As used herein, "central cell" means the female gamete giving rise to the endosperm.

As used herein, "egg cell" means the female gamete giving rise to the embryo.

As used herein, "megaspore mother cell" means the cell that develops into the female gametophyte, also known as a megasporocyte, or functional megaspore (FMS).

As used herein, "microspore mother cell" means the cell that develops into the male gametophyte, also known as a microsporocyte.

As used herein, "gametogenesis" means the development of gametophytes from spores.

As used herein, "parthenogenesis" means the formation of an embryo from an unfertilized egg cell.

As used herein, "pseudogamy" means the fertilization-dependent formation of endosperm from a central cell.

As used herein, "sexual reproduction" means the mode of reproduction whereby female (egg) and male (sperm) gametes fuse to form a zygote.

As used herein, "somatic embryogenesis" means the formation of an embryo from a sporophytic cell without gamete and seed formation.

As used herein, "sporogenesis" means the formation of spores from spore mother cells.

As used herein, "spore mother cell" means the first cell of the reproductive lineage, formed from sporophytic cells in female and male reproductive tissues of the plant.

As used herein, "vegetative reproduction" means a form of reproduction in which a new plant is formed without the formation of an embryo.

As used herein, the term "embryo" means embryos and progeny of the same, immature and mature embryos, immature zygotic embryo, zygotic embryos, somatic embryos, embryogenic callus, and embryos derived from mature ear-derived seed. An embryo is a structure that is capable of germinating to form a plant.

As used herein, "haploid" means a plant or a plant cell having a single set (genome) of chromosomes and the reduced number of chromosomes (n) is equal to that in the gamete.

As used herein, the term "1n" or "1n cell" means a cell containing a single set of chromosomes, typically the product of meiosis. Examples of a 1n cell include gametes such as sperm cells, egg cells, or tissues derived from a gamete through mitotic divisions, such as a 1n embryo or a 1n plant. In maize where the plant is normally diploid, and the gametes are haploid, such gamete-derived embryos or plants are referred to as haploid embryos and haploid plants.

As used herein, "diploid" means a plant or a plant cell having two sets (genomes) of chromosomes and the chromosome number (2n) is equal to that in the zygote.

As used herein, the term "2n" or "2n cell" means a cell containing two sets of chromosomes. Examples of 2n cells include a zygote, an embryo resulting from mitotic divisions of a zygote, or a plant produced by germination of a 2n embryo.

As used herein, "haploid plant" means a plant having a single set (genome) of chromosomes and the reduced number of chromosomes (n) is equal to that in the gamete.

As used herein, the term "diploid plant" means a plant having two sets (genomes) of chromosomes and the chromosome number (2n) is equal to that in the zygote.

As used herein, a "doubled haploid" or a "doubled haploid plant or cell" is one that is developed by the doubling of a haploid set of chromosomes, male or female. A plant or seed that is obtained from a doubled haploid plant that is selfed any number of generations may still be identified as a doubled haploid plant. A doubled haploid plant is considered a homozygous plant. A plant is a doubled haploid if it is fertile, even if the entire vegetative part of the plant does not consist of the cells with the doubled set of chromosomes. For example, a plant is considered a doubled haploid plant if it contains viable gametes, even if it is chimeric.

As used herein, a "doubled haploid embryo" is an embryo that has one or more cells containing 2 sets of homozygous chromosomes that can then be grown into a doubled haploid plant.

As used herein, the term "clonal" means multiple propagated plant cells or plants that are genetically, epigenetically and morphologically identical.

As used herein, the term "gamete" means a 1n reproductive cell such as a sperm cell, an egg cell or an ovule cell resulting from meiosis.

As used herein, the term "haploid embryo" means a gamete-derived somatic structure.

As used herein, the term "somatic structure" means a tissue, organ or organism.

As used herein, the term "somatic cell" is a cell that is not a gamete. Somatic cells, tissues or plants can be haploid, diploid, triploid, tetraploid, hexaploid, etc. A complete set of chromosomes is referred to as being 1n (haploid), with the number of chromosomes found in a single set of chromosomes being referred to as the monoploid number (x). For example, in the diploid plant *Zea mays,* 2n=2x=20 total chromosomes, while in diploid rice *Oryza sativa,* 2n=2x=24 total chromosomes. In a triploid plant, such as banana, 2n=3x=33 total chromosomes. In hexaploid wheat *Triticum aestivum,* 2n=6x=42. Ploidy levels can also vary between cultivars within the same species, such as in sugarcane, *Saccharum officinarum*, where 2n=10x=80 chromosomes, but commercial sugarcane varieties range from 100 to 130 chromosomes.

As used herein, the term "modulate" refers to modifying, controlling, or stabilizing the expression or the strength of expression of a polynucleotide of interest including, but not limited to, up or down regulation.

As used herein, the term "modulator" refers to a polynucleotide that modifies, controls, or stabilizes the expression or the strength of expression of a polynucleotide of interest including, but not limited to, up or down regulation of the polynucleotide of interest.

As used herein, the term "medium" includes compounds in a liquid state, a gaseous state, or a solid state.

As used herein, the term "selectable marker" means a transgene that when expressed in a transformed/transfected cell confers resistance to selective agents such as antibiotics, herbicides and other compounds toxic to an untransformed/untransfected cell.

As used herein, the term "EAR" means an "Ethylene-responsive element binding factor-associated Amphiphilic Repression motif" with a general consensus sequence of LLxLxL, DNLxxP, LxLxPP, R/KLFGV, or TLLLFR that act as transcriptional repression signals within transcription factors. Addition of an EAR-type repressor element to a DNA-binding protein such as a transcription factor, dCAS9, or LEXA (as examples) confers transcriptional repression function to the fusion protein (Kagale, S., and Rozwadowski, K. 2010. Plant Signaling and Behavior 5:691-694).

As used herein, the term "transcription factor" means a protein that controls the rate of transcription of specific genes by binding to the DNA sequence of the promoter and either up-regulating or down-regulating expression. Examples of transcription factors, which are also morphogenic developmental genes, include members of the AP2/EREBP family (including the Babyboom (BBM) and Ovule Development Protein 2 (ODP2) genes and variants, plethora and aintegumenta sub-families, CAAT-box binding proteins such as LEC1 and HAP3, and members of the MYB, bHLH, NAC, MADS, bZIP and WRKY families. In an aspect, ZM-ODP2 (SEQ ID NO: 1 and 11), Os-ODP2 (OsANT (*Oryza sativa* ANT, Genbank Accession NO. AP003313) (SEQ ID NO: 161 encoding SEQ ID NO: 162)), and Os-ODP2 (*Oryza sativa* BMN, Genbank Accession NO. AY062180) (SEQ ID NO: 163 encoding SEQ ID NO: 164)) are useful as morphogenic developmental genes in the methods of the present disclosure.

As used herein, the term "synthetic transcription factor" refers to a molecule comprising at least two domains, a recognition domain and a regulatory domain not naturally occurring in nature.

As used herein, the term "expression cassette" means a distinct component of vector DNA consisting of coding and non-coding sequences including 5' and 3' regulatory sequences that control expression in a transformed/transfected cell.

As used herein, the term "coding sequence" means the portion of DNA sequence bounded by a start and a stop codon that encodes the amino acids of a protein.

As used herein, the term "non-coding sequence" means the portions of a DNA sequence that are transcribed to produce a messenger RNA, but that do not encode the amino acids of a protein, such as 5' untranslated regions, introns and 3' untranslated regions. Non-coding sequence can also refer to RNA molecules such as micro-RNAs, interfering RNA or RNA hairpins, that when expressed can down-regulate expression of an endogenous gene or another transgene.

As used herein, the term "regulatory sequence" means a segment of a nucleic acid molecule which is capable of increasing or decreasing the expression of a gene. Regulatory sequences include promoters, terminators, enhancer elements, silencing elements, 5' UTR and 3' UTR (untranslated region).

As used herein, the term "transfer cassette" means a T-DNA comprising an expression cassette or expression cassettes flanked by the right border and the left border.

As used herein, the term "T-DNA" means a portion of a Ti plasmid that is inserted into the genome of a host plant cell.

As used herein, the term "embryogenesis factor" means a gene that when expressed enhances improved formation of a somatically-derived structure. More precisely, ectopic expression of an embryogenesis factor stimulates de novo formation of an organogenic structure, for example a structure from embryogenic callus tissue, that can improve the formation of an embryo. This stimulated de novo embryogenic formation occurs either in the cell in which the embryogenesis factor is expressed, or in a neighboring cell. An embryogenesis factor gene can be a transcription factor that regulates expression of other genes or a gene that influences hormone levels in a plant cell which can stimulate embryogenic changes.

An embryogenesis factor is involved in plant metabolism, organ development, stem cell development, cell growth stimulation, organogenesis, somatic embryogenesis initiation, accelerated somatic embryo maturation, initiation and/or development of the apical meristem, initiation and/or development of shoot meristem, or a combination thereof.

In an aspect, the present disclosure provides a method for producing maternal haploid plants, comprising expression of a parthenogenesis factor in egg cells resulting in an increased percentage of maternal haploids.

In an aspect, the present disclosure provides a method for producing plants using asexual reproduction. Apogamy, a type of reproduction of flowering plants, is characterized by a diploid cell in the embryo sac developing into an embryo without being fertilized. Parthenogenesis is one form of apogamy and in a broader sense can include de novo embryogenic formation from a haploid gametophytic cell, for example an egg cell resulting from megasporogenesis.

In an aspect, the present disclosure provides a method of (a) infecting a plant cell with a bacterial strain containing a plasmid that comprises a transfer-DNA containing a parthenogenesis factor gene operably linked to a regulatory element active in the egg cell to produce maternal haploids.

The present disclosure provides efficient and effective methods of producing populations of recombinant inbred lines including, but not limited to, methods of initiating parthenogenesis in plant cells to enable generation of doubled haploid recombinant populations.

A parthenogenesis factor can be used in combination with a morphogenic developmental gene involved in plant metabolism, organ development, stem cell development, cell growth stimulation, organogenesis, somatic embryogenesis initiation, accelerated somatic embryo maturation, initiation and/or development of the apical meristem, initiation and/or development of shoot meristem, or combinations thereof to improve maternal haploid production. When parthenogenesis factors are co-expressed with a morphogenic developmental gene improved methods for obtaining a maternal haploid plant are provided. In addition, a parthenogenesis factor can be used in combination with a morphogenic developmental gene and/or an embryogenesis factor.

The present disclosure provides methods for improving parthenogenesis, comprising (a) infecting a plant cell with a bacterial strain containing a plasmid that comprises a transfer-DNA containing a parthenogenesis factor gene and a morphogenic developmental gene and (b) regenerating a maternal haploid. The parthenogenesis factor gene is selected from any of the parthenogenesis factor genes disclosed herein (see Table 5), including, but not limited to, the APETALA2/ethylene-responsive element binding protein (AP2/EREBP) family (including the BBM (ODP2) genes and variants. In an aspect, Os-ODP2 (OsANT (*Oryza sativa* ANT, Genbank Accession NO. AP003313) (SEQ ID NO: 161 encoding SEQ ID NO: 162)), and Os-ODP2 (*Oryza sativa* BMN, Genbank Accession NO. AY062180) (SEQ ID NO: 163 encoding SEQ ID NO: 164)) are useful as parthenogenesis factors in the methods of the present disclosure. The parthenogenic morphogenic developmental gene is selected from a nucleotide sequence encoding a Babyboom (BBM) polypeptide or an Ovule Development Protein 2 (ODP2) polypeptide. Additional parthenogenesis factor genes useful in the methods of the present disclosure are also found in Table 13. The parthenogenesis factors disclosed herein can also be used in combination with a morphogenic developmental gene and/or an embryogenesis factor.

As used herein, the term "morphogenic developmental gene" or "morphogenic gene" means a gene that when ectopically expressed stimulates formation of a somatically-derived structure that can produce a plant. More precisely, ectopic expression of the morphogenic gene stimulates the de novo formation of a somatic embryo or an organogenic structure, such as a shoot meristem, that can produce a plant. This stimulated de novo formation occurs either in the cell in which the morphogenic gene is expressed, or in a neighboring cell. A morphogenic gene can be a transcription factor that regulates expression of other genes, or a gene that influences hormone levels in a plant tissue, both of which can stimulate morphogenic changes. A morphogenic gene may be stably incorporated into the genome of a plant or it may be transiently expressed. As used herein, the term "morphogenic factor" means a morphogenic gene and/or the protein expressed by a morphogenic gene. Some morphogenic developmental genes are parthenogenic.

Morphogenic genes involved in plant metabolism, organ development, stem cell development, cell growth stimulation, organogenesis, regeneration, somatic embryogenesis initiation, accelerated somatic embryo maturation, initiation and/or development of the apical meristem, initiation and/or development of shoot meristem, initiation and/or development of shoots, or a combination thereof, such as WUS/WOX genes (WUS1, WUS2, WUS3, WOX2A, WOX4, WOX5, or WOX9) see U.S. Pat. Nos. 7,348,468 and 7,256,322 and United States Patent Application publications 2017/0121722 and 2007/0271628; Laux et al. (1996) Development 122:87-96; and Mayer et al. (1998) Cell 95:805-815; van der Graaff et al., 2009, Genome Biology 10:248; Dolzblasz et al. 2016. Mol. Plant 19:1028-39 are useful in the methods of the disclosure. Modulation of WUS/WOX is expected to modulate plant and/or plant tissue phenotype including plant metabolism, organ development, stem cell development, cell growth stimulation, organogenesis, regeneration, somatic embryogenesis initiation, accelerated somatic embryo maturation, initiation and/or development of the apical meristem, initiation and/or development of shoot meristem, initiation and/or development of shoots, or a combination thereof. Expression of *Arabidopsis* WUS can induce stem cells in vegetative tissues, which can differentiate into somatic embryos (Zuo, et al. (2002) Plant J 30:349-359). Additional genes useful in the methods disclosed herein include, but are not limited to, a MYB118 gene (see U.S. Pat. No. 7,148,402), a MYB115 gene (see Wang et al. (2008) Cell Research 224-235), a BABYBOOM gene (BBM; see Boutilier et al. (2002) Plant Cell 14:1737-1749), or a CLAVATA gene (see, for example, U.S. Pat. No. 7,179,963). Morphogenic genes useful in the present disclosure include, but are not limited to, functional WUS/WOX genes.

Morphogenic polynucleotide sequences and amino acid sequences of WUS/WOX homeobox polypeptides are useful in the disclosed methods. As defined herein, a "functional WUS/WOX nucleotide" or a "functional WUS/WOX gene" is any polynucleotide encoding a protein that contains a homeobox DNA binding domain, a WUS box, and an EAR repressor domain (Ikeda et al., 2009 Plant Cell 21:3493-3505). As demonstrated by Rodriguez et al., 2016 PNAS www.pnas.org/cgi/doi/10.1073/pnas.1607673113 removal of the dimerization sequence which leaves behind the homeobox DNA binding domain, a WUS box, and an EAR repressor domain results in a functional WUS/WOX polypeptide. The WUSCHEL protein, designated hereafter as WUS, plays a key role in the initiation and maintenance of the apical meristem, which contains a pool of pluripotent stem cells (Endrizzi et al., (1996) Plant Journal 10:967-979; Laux, et al., (1996) Development 122:87-96; and Mayer, et al., (1998) Cell 95:805-815). *Arabidopsis* plants mutant for the WUS gene contain stem cells that are misspecified and that appear to undergo differentiation. WUS encodes a homeodomain protein which presumably functions as a transcriptional regulator (Mayer, et al., (1998) Cell 95:805-815). The stem cell population of *Arabidopsis* shoot meristems is believed to be maintained by a regulatory loop between the CLAVATA (CLV) genes which promote organ initiation and the WUS gene which is required for stem cell identity, with the CLV genes repressing WUS at the transcript level, and WUS expression being sufficient to induce meristem cell identity and the expression of the stem cell marker CLV3 (Brand, et al., (2000) Science 289:617-619; Schoof, et al., (2000) Cell 100:635-644). Constitutive expression of WUS in *Arabidopsis* has been shown to lead to adventitious shoot proliferation from leaves (in planta) (Laux, T., Talk Presented at the XVI International Botanical Congress Meeting, Aug. 1-7, 1999, St. Louis, Mo.).

In an aspect, the functional WUS/WOX homeobox polypeptide useful in the methods of the disclosure is a WUS1, WUS2, WUS3, WOX2A, WOX4, WOX5, WOX5A, or WOX9 polypeptide (see, U.S. Pat. Nos. 7,348,468 and 7,256,322 and US Patent Application Publication Numbers 2017/0121722 and 2007/0271628, herein incorporated by reference in their entirety and van der Graaff et al., 2009, Genome Biology 10:248). The functional WUS/WOX homeobox polypeptide useful in the methods of the disclosure is obtained from or derived from any plant. Functional WUS/WOX nucleotides encoding proteins that contain a homeobox DNA binding domain, a WUS box, and an EAR repressor domain useful in the methods of the present disclosure are disclosed in US Patent Application Publication Number 2020/0270622 incorporated herein by reference in its entirety.

Other morphogenic genes useful in the present disclosure include, but are not limited to, LEC1 (U.S. Pat. No. 6,825,397 incorporated herein by reference in its entirety, Lotan et al., 1998, Cell 93:1195-1205), LEC2 (Stone et al., 2008, PNAS 105:3151-3156; Belide et al., 2013, Plant Cell Tiss. Organ Cult 113:543-553), KN1/STM (Sinha et al., 1993. Genes Dev 7:787-795), the IPT gene from *Agrobacterium* (Ebinuma and Komamine, 2001, In vitro Cell. Dev Biol—Plant 37:103-113), MONOPTEROS-DELTA (Ckurshumova et al., 2014, New Phytol. 204:556-566), the *Agrobacterium* AV-6b gene (Wabiko and Minemura 1996, Plant Physiol. 112:939-951), the combination of the *Agrobacterium* IAA-h and IAA-m genes (Endo et al., 2002, Plant Cell Rep., 20:923-928), the *Arabidopsis* SERK gene (Hecht et al., 2001, Plant Physiol. 127:803-816), the *Arabidopsis* AGL15 gene (Harding et al., 2003, Plant Physiol. 133:653-663), the FUSCA gene (Castle and Meinke, Plant Cell 6:25-41), and the PICKLE gene (Ogas et al., 1999, PNAS 96:13839-13844).

The present disclosure also includes plants obtained by any of the disclosed methods or compositions herein. The present disclosure also includes seeds from a plant obtained by any of the methods or compositions disclosed herein. As used herein, the term "plant" refers to whole plants, plant organs (e.g., leaves, stems, roots, etc.), plant tissues, plant cells, plant parts, seeds, propagules, embryos and progeny of the same. As used herein, the term "plant" refers to whole plants, plant organs (e.g., leaves, stems, roots, etc.), plant tissues, plant cells, plant parts, seeds, propagules, embryos and progeny of the same. Plant cells are differentiated or undifferentiated (e.g. callus, undifferentiated callus, immature and mature embryos, immature zygotic embryo, immature cotyledon, embryonic axis, suspension culture cells, protoplasts, leaf, leaf cells, root cells, phloem cells and pollen). Plant cells include, without limitation, cells from seeds, suspension cultures, explants, immature embryos, embryos, zygotic embryos, somatic embryos, embryogenic callus, meristem, somatic meristems, organogenic callus, protoplasts, embryos derived from mature ear-derived seed, leaf bases, leaves from mature plants, leaf tips, immature inflorescences, tassel, immature ear, silks, cotyledons, immature cotyledons, meristematic regions, callus tissue, cells from leaves, cells from stems, cells from roots, cells from shoots, gametophytes, sporophytes, pollen, microspores, multicellular structures (MCS), and embryo-like structures (ELS). Plant parts include differentiated and undifferentiated tissues including, but not limited to, roots, stems, shoots, leaves, pollen, seeds, tumor tissue and various forms of cells in culture (e. g., single cells, protoplasts, embryos, and callus tissue). The plant tissue may be in a plant or in a plant organ, tissue, or cell culture. Grain is intended to mean the mature seed produced by commercial growers for purposes other than growing or reproducing the species. Progeny, variants and mutants of the regenerated plants are also included within the scope of the disclosure, provided these progeny, variants and mutants are derived from regenerated plants made using the methods and compositions disclosed herein and/or comprise the introduced polynucleotides disclosed herein.

As used herein, the terms "transformed plant" and "transgenic plant" refer to a plant that comprises within its genome a heterologous polynucleotide. Generally, the heterologous polynucleotide is stably integrated within the genome of a transgenic or transformed plant such that the polynucleotide is passed on to successive generations. The heterologous polynucleotide may be integrated into the genome alone or as part of a recombinant DNA construct. It is to be understood that as used herein the term "transgenic" includes any cell, cell line, callus, tissue, plant part or plant the genotype of which has been altered by the presence of a heterologous nucleic acid including those transgenics initially so altered as well as those created by sexual crosses or asexual propagation from the initial transgenic. A transgenic plant is defined as a mature, fertile plant that contains a transgene.

A transgenic "event" is produced by transformation of plant cells with a heterologous DNA construct, including a nucleic acid expression cassette that comprises a gene of interest, the regeneration of a population of plants resulting from the insertion of the transferred gene into the genome of the plant and selection of a plant characterized by insertion into a particular genome location. An event is characterized phenotypically by the expression of the inserted gene. At the genetic level, an event is part of the genetic makeup of a plant. The term "event" also refers to progeny produced by a sexual cross between the transformant and another plant wherein the progeny include the heterologous DNA.

The compositions and methods of the present disclosure are applicable to a broad range of plant species, including dicotyledonous plants and monocotyledonous plants. Representative examples of plants that are treated in accordance with the methods disclosed herein include, but are not limited to, wheat, cotton, sunflower, safflower, tobacco, *Arabidopsis*, barley, oats, rice, maize, triticale, sorghum, rye, millet, flax, sugarcane, banana, cassava, common bean, cowpea, tomato, potato, beet, grape, *Eucalyptus*, wheat grasses, turf grasses, alfalfa, clover, soybean, peanuts, citrus, papaya, *Setaria* sp, cacao, cucumber, apple, *Capsicum*, bamboo, melon, ornamentals including commercial garden and flower bulb species, fruit trees, vegetable species, *Brassica* species, as well as interspecies hybrids. In a preferred embodiment, the compositions and methods of the disclosure are applied to maize plants.

The methods of the disclosure involve introducing a polypeptide, polynucleotide (i.e., DNA or RNA), or nucleotide construct (i.e., DNA or RNA) into a plant. As used herein, "introducing" means presenting to the plant the polynucleotide, polypeptide, or nucleotide construct in such a manner that the polynucleotide, polypeptide, or nucleotide construct gains access to the interior of a cell of the plant. The methods of the disclosure do not depend on a particular method for introducing the polynucleotide, polypeptide, or nucleotide construct into a plant, only that the polynucleotide, polypeptide, or nucleotide construct gains access to the interior of at least one cell of the plant. Methods for introducing polynucleotides, polypeptides, or nucleotide constructs into plants include, but are not limited to, stable transformation methods, transient transformation methods and virus-mediated methods.

As used herein, a "stable transformation" is a transformation in which the polynucleotide or nucleotide construct introduced into a plant integrates into the genome of the plant and is capable of being inherited by the progeny thereof. "Transient transformation" means that a polynucleotide or nucleotide construct is introduced into the plant and does not integrate into the genome of the plant or a polypeptide is introduced into a plant. In addition, "transient", in certain embodiments may represent the presence of a parthenogenesis inducing agent in a cell where such an agent has been exogenously applied or secreted from a neighboring cell or is being produced from an extrachromosomal location (e.g., plasmid or another independently replicating origin), or not produced by a stably integrated recombinant DNA construct within the same cell.

As used herein, "contacting", "comes in contact with" or "in contact with" mean "direct contact" or "indirect contact". For example, cells are placed in a condition where the cells can come into contact with any of the parthenogenesis factors disclosed herein and/or an embryogenesis factor, a morphogenic developmental gene, a small molecule, or a doubling agent. Such substance is allowed to be present in an environment where the cells survive (for example, medium or expressed in the cell or expressed in an adjacent cell) and can act on the cells. For example, the medium comprising a doubling agent may have direct contact with the haploid cell or the medium comprising the doubling agent may be separated from the haploid cell by filter paper, plant tissues, or other cells thus the doubling agent is transferred through the filter paper or cells to the haploid cell.

As used herein, the term "biparental cross" is the cross-fertilization of two genetically different plants to obtain the first filial ($F_1$) generation of offspring and/or any successive filial generation thereafter. As used herein a biparental cross includes the offspring that are the progeny of any filial generation of offspring, including cross-fertilizing an offspring to one of its parental lines or an individual genetically like its parent to obtain progeny with a genetic identity closer to that of the parent referred to as a "backcross" and/or any successive backcross generation thereafter.

The methods provided herein rely upon the use of bacteria-mediated and/or biolistic-mediated gene transfer to produce regenerable plant cells. Bacterial strains useful in the methods of the disclosure include, but are not limited to, a disarmed Agrobacteria, an *Ochrobactrum* bacteria or a Rhizobiaceae bacteria (U.S. Pat. No. 9,365,859 incorporated herein by reference in its entirety). Standard protocols for particle bombardment (Finer and McMullen, 1991, In Vitro Cell Dev. Biol.—Plant 27:175-182), *Agrobacterium*-mediated transformation (Jia et al., 2015, Int J. Mol. Sci. 16:18552-18543; US2017/0121722 incorporated herein by reference in its entirety), or Ochrobactrum-mediated transformation (US2018/0216123 incorporated herein by reference in its entirety) can be used with the methods and compositions of the disclosure. Numerous methods for introducing heterologous genes into plants are known and can be used to insert a polynucleotide into a plant host, including biological and physical plant transformation protocols. See, e.g., Miki et al., "Procedure for Introducing Foreign DNA into Plants," in Methods in Plant Molecular Biology and Biotechnology, Glick and Thompson, eds., CRC Press, Inc., Boca Raton, pp. 67-88 (1993). The methods chosen vary with the host plant and include chemical transfection methods such as calcium phosphate, microorganism-mediated gene transfer such as *Agrobacterium* (Horsch, et al., (1985) Science 227:1229-31), Ochrobactrum (US2018/0216123), electroporation, micro-injection and biolistic bombardment. Expression cassettes and vectors and in vitro culture methods for plant cell or tissue transformation and regeneration of transgenic plants are known and available. See, e.g., Gruber, et al., "Vectors for Plant Transformation," in Methods in Plant Molecular Biology and Biotechnology, supra, pp. 89-119.

Transformation protocols as well as protocols for introducing nucleotide sequences into plants may vary depending on the type of plant or plant cell, i.e., monocot or dicot, targeted for transformation. Suitable methods of introducing nucleotide sequences into plant cells and subsequent insertion into the plant genome include microinjection (Crossway, et al., (1986) *Biotechniques* 4:320-334), electroporation (Riggs, et al., (1986) *Proc. Natl. Acad. Sci. USA* 83:5602-5606), *Agrobacterium*-mediated transformation (Townsend, et al., U.S. Pat. No. 5,563,055 and Zhao, et al., U.S. Pat. No. 5,981,840), *Ochrobactrum*-mediated transformation (US2018/0216123), direct gene transfer (Paszkowski, et al., (1984) *EMBO J.* 3:2717-2722) and ballistic particle acceleration (see, for example, U.S. Pat. Nos. 4,945,050; 5,879,918; 5,886,244; 5,932,782; Tomes, et al., (1995) in Plant Cell, Tissue, and Organ Culture: Fundamental Methods, ed. Gamborg and Phillips (Springer-Verlag, Berlin); McCabe, et al., (1988) *Biotechnology* 6:923-926) and Lec1 transformation (WO 00/28058). See also, Weissinger, et al., (1988) *Ann. Rev. Genet.* 22:421-477; Sanford, et al., (1987) *Particulate Science and Technology* 5:27-37 (onion); Christou, et al., (1988) *Plant Physiol.* 87:671-674 (soybean); McCabe, et al., (1988) *Bio Technology* 6:923-926 (soybean); Finer and McMullen, (1991) *In Vitro Cell Dev. Biol.* 27P:175-182 (soybean); Singh, et al., (1998) *Theor. Appl. Genet.* 96:319-324 (soybean); Datta, et al., (1990) *Biotechnology* 8:736-740 (rice); Klein, et al., (1988) *Proc. Natl. Acad. Sci. USA* 85:4305-4309 (maize); Klein, et al., (1988) *Biotechnology* 6:559-563 (maize); U.S. Pat. Nos. 5,240,855; 5,322,783 and 5,324,646; Klein, et al., (1988) *Plant Physiol.* 91:440-444 (maize); Fromm, et al., (1990) *Biotechnology* 8:833-839 (maize); Hooykaas-Van Slogteren, et al., (1984) *Nature* (London) 311:763-764; U.S. Pat. No. 5,736,369 (cereals); Bytebier, et al., (1987) *Proc. Natl. Acad. Sci. USA* 84:5345-5349 (Liliaceae); De Wet, et al., (1985) in The Experimental Manipulation of Ovule Tissues, ed. Chapman, et al., (*Longman*, New York), pp. 197-209 (pollen); Kaeppler, et al., (1990) *Plant Cell Reports* 9:415-418 and Kaeppler, et al., (1992) *Theor. Appl. Genet.* 84:560-566 (whisker-mediated transformation); D'Halluin, et al., (1992) *Plant Cell* 4:1495-1505 (electroporation); Li, et al., (1993) *Plant Cell Reports* 12:250-255 and Christou and Ford, (1995) *Annals of Botany* 75:407-413 (rice); Ishida, et al., (1996) *Nature Biotechnology* 14:745-750 (maize via *Agrobacterium tumefaciens*), all of which are herein incorporated by reference in their entirety. Methods and compositions for rapid plant transformation are also found in U.S. 2017/0121722, herein incorporated in its entirety by reference. Vectors useful in plant transformation are found in U.S. patent application Ser. No. 15/765,521, herein incorporated by reference in its entirety.

The compositions and methods of the present disclosure include producing doubled haploid plants from gametes by contacting a plant cell with a parthenogenesis factor gene product and/or a morphogenic developmental gene, and/or an embryogenesis factor that can induce cellular reprogramming and activate parthenogenesis within the cell.

The present disclosure provides a method of inducing parthenogenesis and regenerating maternal haploids by transforming a maize non-haploid inducer line to express a heterologous expression cassette encoding a parthenogenesis factor and a morphogenic gene and also encoding an additional component including genes useful for gene editing purposes. Reporter genes or selectable marker genes may also be included in the expression cassettes of the present disclosure. Examples of suitable reporter genes are found in, for example, Jefferson, et al., (1991) in Plant Molecular Biology Manual, ed. Gelvin, et al., (Kluwer Academic Publishers), pp. 1-33; DeWet, et al., (1987) *Mol. Cell. Biol.* 7:725-737; Goff, et al., (1990) *EMBO J.* 9:2517-2522; Kain, et al., (1995) *Bio Techniques* 19:650-655 and Chiu, et al., (1996) *Current Biology* 6:325-330, herein incorporated by reference in their entirety.

Selectable marker genes for selection of transformed cells or tissues can include genes that confer antibiotic resistance or resistance to herbicides. Examples of suitable selectable marker genes include, but are not limited to, genes encoding resistance to chloramphenicol (Herrera Estrella, et al., (1983) *EMBO J.* 2:987-992); methotrexate (Herrera Estrella, et al., (1983) *Nature* 303:209-213; Meijer, et al., (1991) *Plant Mol. Biol.* 16:807-820); hygromycin (Waldron, et al., (1985) *Plant Mol. Biol.* 5:103-108 and Zhijian, et al., (1995) *Plant Science* 108:219-227); streptomycin (Jones, et al., (1987) *Mol. Gen. Genet.* 210:86-91); spectinomycin (Bretagne-Sagnard, et al., (1996) *Transgenic Res.* 5:131-137); bleomycin (Hille, et al., (1990) *Plant Mol. Biol.* 7:171-176); sulfonamide (Guerineau, et al., (1990) *Plant Mol. Biol.* 15:127-36); bromoxynil (Stalker, et al., (1988) *Science* 242:419-423); glyphosate (Shaw, et al., (1986) *Science* 233:478-481 and U.S. patent application Ser. Nos. 10/004,357 and 10/427,692); phosphinothricin (DeBlock, et al., (1987) *EMBO J.* 6:2513-2518), herein incorporated by reference in their entirety.

Other genes may be used the expression cassettes of the present disclosure that also assist in the recovery of transgenic events and include, but are not limited to, GUS (beta-glucuronidase; Jefferson, (1987) *Plant Mol. Biol. Rep.* 5:387), GFP (green fluorescence protein; Chalfie, et al., (1994) *Science* 263:802), luciferase (Riggs, et al., (1987) *Nucleic Acids Res.* 15(19):8115 and Luehrsen, et al., (1992) *Methods Enzymol.* 216:397-414) and the maize genes encoding for anthocyanin production (Ludwig, et al., (1990) *Science* 247:449), herein incorporated by reference in their entirety.

The present disclosure also provides methods of contacting haploid cells with an amount of a chromosome doubling agent before, during, after, or overlapping with any portion of the isolation and embryogenesis induction process used for generating a paternal gamete (androgenic) or a maternal gamete (gynogenic) doubled haploid population.

As used herein "recombinant" means a cell or vector, that has been modified by the introduction of a heterologous nucleic acid or a cell derived from a cell so modified. Thus, for example, a recombinant cell is a cell expressing a gene that is not found in identical form or location within the native (non-recombinant) cell or a cell that expresses a native gene in an expression pattern that is different from that of the native (non-recombinant) cell for example, the native gene is abnormally expressed, under expressed, has reduced expression or is not expressed at all because of deliberate human intervention. The term "recombinant" as used herein does not encompass the alteration of a cell or vector by naturally occurring events (e.g., spontaneous mutation, natural transformation/transduction/transposition) such as those occurring without deliberate human intervention.

As used herein, a "recombinant expression cassette" is a nucleic acid construct, generated recombinantly or synthetically, with a series of specified nucleic acid elements, which permit transcription of a particular nucleic acid in a target cell. The recombinant expression cassette is incorporated into a plasmid, chromosome, mitochondrial DNA, plastid DNA, virus or nucleic acid fragment. Typically, the recombinant expression cassette portion of an expression vector includes, among other sequences, a nucleic acid to be transcribed and a promoter.

The terms "polypeptide," "peptide" and "protein" are used interchangeably herein to refer to a polymer of amino acid residues. The terms apply to amino acid polymers in which one or more amino acid residue is an artificial chemical analogue of a corresponding naturally occurring amino acid, as well as to naturally occurring amino acid polymers.

The term "regulatory element" refers to a nucleic acid molecule having gene regulatory activity, i.e. one that has the ability to affect the transcriptional and/or translational expression pattern of an operably linked transcribable polynucleotide. The term "gene regulatory activity" thus refers to the ability to affect the expression of an operably linked transcribable polynucleotide molecule by affecting the transcription and/or translation of that operably linked transcribable polynucleotide molecule. Gene regulatory activity may be positive and/or negative and the effect may be characterized by its temporal, spatial, developmental, tissue, environmental, physiological, pathological, cell cycle, and/or chemically responsive qualities as well as by quantitative or qualitative indications.

In an aspect, a regulatory element expressed in the egg cell of the plant is useful for regulating ZM-ODP2 peptide activity to induce maternal haploid induction, resulting in a percentage of the progeny produced being haploid (having half the number of chromosomes compared to the parent). In addition, alternative regulatory elements are used to further optimize parthenogenic maternal haploid induction levels. For example, regulatory elements such as those disclosed in US2015/0152430 (promoters including, but not limited to the AT-DD5 promoter, the AT-DD31 promoter, the AT-DD65 promoter, and the ZM-DD45) and those disclosed in US2018/0094273 (*Zea mays* egg cell promoters) are used in the methods of the present disclosure (US2015/0152430 and US2018/0094273 incorporated herein by reference in their entireties).

Cis regulatory elements are regulatory elements that affect gene expression. Cis regulatory elements are regions of non-coding DNA that regulate the transcription of neighboring genes, often as DNA sequences in the vicinity of the genes that they regulate. Cis regulatory elements typically regulate gene transcription by encoding DNA sequences conferring transcription factor binding.

As used herein "promoter" is an exemplary regulatory element and generally refers to a nucleotide sequence capable of controlling the expression of a coding sequence or functional RNA. In general, a coding sequence is located 3' to a promoter sequence. The promoter sequence comprises proximal and more distal upstream elements, the latter elements are often referred to as enhancers. Accordingly, an "enhancer" is a nucleotide sequence that can stimulate promoter activity and may be an innate element of the promoter or a heterologous element inserted to enhance the level or tissue-specificity of a promoter.

Promoters may be derived in their entirety from a native gene or may be composed of different elements derived from different promoters found in nature, or even comprise synthetic nucleotide segments. Different regulatory elements may direct the expression of a gene in different tissues or cell types, or at different stages of development, or in response to different environmental conditions.

A "plant promoter" is a promoter capable of initiating transcription in plant cells. Exemplary plant promoters include, but are not limited to, those that are obtained from plants, plant viruses, and bacteria such as *Agrobacterium* or *Rhizobium*, which comprise genes expressed in plant cells. Examples are promoters that preferentially initiate transcription in certain tissues, such as leaves, roots, seeds, fibers, xylem vessels, tracheids or sclerenchyma. Such promoters are referred to as "tissue preferred" promoters. A "cell type" specific promoter primarily drives expression in certain cell types in one or more organs, for example, vascular cells in roots or leaves. An "inducible" or "regulatable" promoter is a promoter which is under environmental control. Examples of environmental conditions that may affect transcription by inducible promoters include anaerobic conditions or the presence of light. Another type of promoter is a developmentally regulated promoter, for example, a promoter that drives expression during pollen development. Tissue preferred, cell type specific, developmentally regulated and inducible promoters are members of the class of "non-constitutive" promoters. A "constitutive" promoter is a promoter that causes a nucleic acid fragment to be expressed in most cell types at most times under most environmental conditions and states of development or cell differentiation.

In an aspect, egg cell promoters and egg cell specific promoters are useful in the methods of the present disclosure. In addition to those egg cell promoters and/or egg cell specific promoters disclosed herein and those disclosed in US2015/0152430 and US2018/0094273, each of which is incorporated herein in its entirety, egg cell promoters and/or egg cell specific promoters useful in the present disclosure include, but are not limited to the egg cell-specific EC1.1 and EC1.2 promoters disclosed in Sprunck et al., (2012) Science, 338, 1093-1097 and Steffen et al., (2007) Plant J., 51:281-92.

A "translation leader sequence" refers to a nucleotide sequence located between the promoter sequence of a gene and the coding sequence. The translation leader sequence is present in the fully processed mRNA upstream of the translation start sequence. The translation leader sequence may affect numerous parameters including, processing of the primary transcript to mRNA, mRNA stability and/or translation efficiency. Examples of translation leader sequences have been described (Turner and Foster (1995) *Mol. Biotechnol.* 3:225-236).

As used herein, "heterologous" refers to a nucleic acid that originates from a foreign species, or, if from the same species, is substantially modified from its native form in composition and/or genomic locus by deliberate human intervention. For example, a promoter operably linked to a heterologous structural gene that is from a species different from that from which the structural gene was derived, or, if from the same species, one or both are substantially modified from their original form and/or genomic location.

The parthenogenesis factors and morphogenic developmental genes useful in the methods of the disclosure are provided in expression cassettes for expression in a plant of interest. The cassette can include 5' and 3' regulatory sequences operably linked to a parthenogenesis factor and morphogenic developmental gene sequence disclosed herein. "Operably linked" is intended to mean a functional linkage between two or more elements. For example, an operable linkage between a polynucleotide of interest and a regulatory sequence (i.e., a promoter) is a functional link that allows for expression of the polynucleotide of interest. Operably linked elements may be contiguous or non-contiguous. When used to refer to the joining of two protein coding regions (fusion proteins), by operably linked it is intended that the coding regions are in the same reading frame. The cassette may additionally contain at least one additional gene to be co-transformed into the organism. Alternatively, the parthenogenesis factor and morphogenic developmental gene(s) are provided on multiple expression cassettes. Such an expression cassette is provided with a plurality of restriction sites for insertion of the parthenogenesis factor and morphogenic developmental gene sequence to be under the transcriptional regulation of the regulatory regions (promoter(s)). The expression cassette may additionally contain selectable marker genes.

Polynucleotides useful in the methods of the disclosure include, but are not limited to, parthenogenesis factors, morphogenic developmental genes, and cell cycle genes including Cyclin A, Cyclin B, Cyclin C, Cyclin D, Cyclin E, Cyclin F, Cyclin G, and Cyclin H; Pin1; E2F; Cdc25; RepA genes and similar plant viral polynucleotides encoding replication-associated proteins. See U.S. Patent Publication No. 2002/0188965 incorporated herein by reference in its entirety.

As used herein, a "chimeric gene expression cassette" is an expression cassette comprising a coding sequence operably linked to a transcription initiation region that is heterologous to the coding sequence and can include in the 5'-3' direction of transcription, a transcriptional initiation region (i.e., a promoter) and translational initiation region, a secretion signal peptide, a parthenogenesis inducing gene sequence, a fluorescent protein sequence, and a transcriptional and translational termination region (i.e., termination region) functional in plants. Additional components including, but not limited to morphogenic developmental genes and/or embryogenesis factors may also be found in the chimeric gene expression cassette.

The parthenogenesis inducing methods of the disclosure improve maternal haploid embryo regeneration productivity and enable gene editing to provide regenerated gene-edited, maize maternal haploids.

In an aspect, haploid cells are contacted with an amount of a chromosome doubling agent to promote chromosome doubling followed by regenerating homozygous diploid plants from the treated haploid cells. The haploid microspore cells are in contact with the doubling agent before, during, or after initiation of microspore embryogenesis or embryo maturation. After chromosome doubling, the doubled haploid embryo will contain 2 copies of paternally derived chromosomes. The efficiency of the process for obtaining doubled haploid plants from haploid embryos may be greater than 10%, 20%, 30%, 50%, 60%, 70%, 80%, or 90%. The duration of contact between the haploid cells and the chromosomal doubling agent may vary. Contact may be from less than 24 hours, for example 4-12 hours, to about a week. The duration of contact is generally from about 8 hours to 2 days.

Methods of chromosome doubling are disclosed in Antoine-Michard, S. et al., Plant cell, tissue organ cult., Cordrecht, the Netherlands, Kluwer Academic Publishers, 1997, 48(3):203-207; Kato, A., Maize Genetics Cooperation Newsletter 1997, 36-37; and Wan, Y. et al., TAG, 1989, 77: 889-892. Wan, Y. et al., TAG, 1991, 81: 205-211. The disclosures of which are incorporated herein by reference. Typical doubling methods involve contacting the cells with colchicine, anti-microtubule agents or anti-microtubule herbicides, pronamide, nitrous oxide, or any mitotic inhibitor to create homozygous doubled haploid cells. The amount of colchicine used in medium is generally 0.010-0.2% or approximately 0.0% of amiprophos-methyl (APM) (5-225 M) may be used. The amount of colchicine can range from approximately 400-600 mg/L or approximately 500 mg/L. The amount of pronamide in medium is approximately 0.5-20 μM. Examples of mitotic inhibitors are included in Table 1. Other agents may be used with the mitotic inhibitors to improve doubling efficiency. Such agents include dimethyl sulfoxide (DMSO), adjuvants, surfactants, and the like.

TABLE 1

| Chemical chromosome doubling agents | | |
|---|---|---|
| Common Name/ Trade name | CAS | IUPAC |
| Colchicine and Colchicine Derivatives | | |
| colchicine/ acetyltrimethylcol-chicinic acid colchicine derivatives | | (S)-N-(5,6,7,9-tetrahydro-1,2,3,10-tetramethoxy-9-oxobenzo(a) heptalen-7-yl)acetamide |
| Carbamates | | |
| Carbetamide | (R)-1-(ethylcarbamoyl)ethyl carbanilate | (2R)-N-ethyl-2-[[(phenylamino)carbonyl]oxy]propanamide |
| chloropropham | | |
| Propham | | |
| Benzamides | | |
| Pronamide/ propyzamide | 3,5-dichloro-N-(1,1-dimethylpropynyl)benzamide | 3,5-dichloro-N-(1,1-dimethyl-2-propynyl)benzamide |
| Tebutam | | |
| Benzoic Acids | | |
| Chlorthal dimethyl (DCPA), | | |
| Dicamba/dianat/ disugran (dicamba-methyl) (BANVEL, CLARITY) | 3,6-dichloro-o-anisic acid | 3,6-dichloro-2-methoxybenzoic acid |
| Dinitroaniline chromosome doubling agents | | |
| benfluralin/benefin/ (BALAN) | N-butyl-N-ethyl-α,α,α-trifluoro-2,6-dinitro-p-toluidine | N-butyl-N-ethyl-2,6-dinitro-4-(trifluoromethyl)benzenamine |
| Butralin | (RS)-N-sec-butyl-4-tert-butyl-2,6-dinitroaniline | 4-(1,1-dimethylethyl)-N-(1-methylpropyl)-2,6-dinitrobenzenamine |
| Chloralin | | |
| dinitramine | N1,N1-diethyl-2,6-dinitro-4-trifluoromethyl-m-phenylenediamine | N3,N3-diethyl-2,4-dinitro-6-(trifluoromethyl)-1,3-benzenediamine |
| ethalfluralin (Sonalan) | N-ethyl-α,α,α-trifluoro-N-(2-methylallyl)-2,6-dinitro-p-toluidine | N-ethyl-N-(2-methyl-2-propenyl)-2,6-dinitro-4-(trifluoromethyl)benzenamine |
| fluchloralin | N-(2-chloroethyl)-2,6-dinitro-N-propyl-4-(trifluoromethyl)aniline or N-(2-chloroethyl)-α,α,α-trifluoro-2,6-dinitro-N-propyl-p-toluidine | N-(2-chloroethyl)-2,6-dinitro-N-propyl-4-(trifluoromethyl)benzenamine |
| isopropalin | 4-isopropyl-2,6-dinitro-N,N-dipropylaniline | 4-(1-methylethyl)-2,6-dinitro-N,N-dipropylbenzenamine |
| methalpropalin | α,α,α-trifluoro-N-(2-methylallyl)-2,6-dinitro-N-propyl-p-toluidine | N-(2-methyl-2-propenyl)-2,6-dinitro-N-propyl-4-(trifluoromethyl)benzenamine |
| nitralin | 4-methylsulfonyl-2,6-dinitro-N,N-dipropylaniline | 4-(methylsulfonyl)-2,6-dinitro-N,N-dipropylbenzenamine |
| oryzalin (SURFLAN) | 3,5-dinitro-N4,N4-dipropylsulfanilamide | 4-(dipropylamino)-3,5-dinitrobenzenesulfonamide |
| pendimethalin (PROWL) | N-(1-ethylpropyl)-2,6-dinitro-3,4-xylidine | N-(1-ethylpropyl)-3,4-dimethyl-2,6-dinitrobenzenamine |
| prodiamine | 5-dipropylamino-α,α,α-trifluoro-4,6-dinitro-o-toluidine or 2,6-dinitro-N1,N1-dipropyl-4-trifluoromethyl-m-phenylenediamine | 2,4-dinitro-N3,N3-dipropyl-6-(trifluoromethyl)-1,3-benzenediamine |
| profluralin | N-cyclopropylmethyl-α,α,α-trifluoro-2,6-dinitro-N-propyl-p-toluidine or N-cyclopropylmethyl-2,6-dinitro-N-propyl-4-trifluoromethylaniline | N-(cyclopropylmethyl)-2,6-dinitro-N-propyl-4-(trifluoromethyl)benzenamine |

TABLE 1-continued

| Chemical chromosome doubling agents | | |
|---|---|---|
| Common Name/ Trade name | CAS | IUPAC |
| trifluralin (TREFLAN, TRIFIC, TRILLIN) | α,α,α-trifluoro-2,6-dinitro-N,N-dipropyl-p-toluidine | 2,6-dinitro-N,N-dipropyl-4-(trifluoromethyl)benzenamine |
| Phosphoroamidates | | |
| APM (Amiprofos methyl); amiprophos-methyl | | |
| Butamifos | O-ethyl O-6-nitro-m-tolyl (RS)-sec-butylphosphoramidothioate | O-ethyl O-(5-methyl-2-nitrophenyl) (1-methylpropyl)phosphoramidothioate |
| Pyridines | | |
| Dithiopyr | | |
| Thiazopyr | methyl 2-difluoromethyl-5-(4,5-dihydro-1,3-thiazol-2-yl)-4-isobutyl-6-trifluoromethylnicotinate | methyl 2-(difluoromethyl)-5-(4,5-dihydro-2-thiazolyl)-4-(2-methylpropyl)-6-(trifluoromethyl)-3-pyridinecarboxylate |

As an alternative to using chemical chromosome doubling agents, modulating expression of genes known to impact the plant cell cycle (genetic chromosome doubling protein), either through stimulation of the cell cycle (and cell division) or through stimulation of endoreduplication, are used to double the chromosome complement in an embryo. Increasing ploidy level in plant cells is achieved by modulating expression of genes that stimulate key control points in the cell cycle cell. In the present disclosure it has been demonstrated that expression of parthenogenic factors using an egg cell promoter enhanced formation of maternal haploid embryos, while simultaneous expression of parthenogenic factors and ZM-DZ470 (a maize cyclin-D family member) not only resulted in maternal haploid embryo formation but also stimulated doubling of the chromosome number. Thus, the addition of cyclin-D over-expression in the forming maternal haploid embryo appears to provide an appropriate level of cell cycle stimulation to result in doubling of the in haploid chromosome number to 2n (diploid). It is expected that other plant genes known to simulate the cell cycle (or cell division) in plants are used to produce a similar doubling of the chromosome number in the forming maternal haploid embryos. Examples of plant genes whose over-expression stimulates the cell cycle include cyclin-A in tobacco (Yu et al., 2003), cyclin-D in tobacco (Cockcroft et al., 2000, Nature 405:575-79; Schnittger et al., 2002, PNAS 99:6410-6415; Dewitte et al., 2003, Plant Cell 15:79-92)., E2FA in *Arabidopsis* (De Veylder et al., 2002, EMBO J 21:1360-1368), E2FB in *Arabidopsis* (Magyar et al., 2005, Plant Cell 17:2527-2541). Similarly, over-expression of viral genes known to modulate plant cell cycle machinery are used, such as when over-expression of the Wheat Dwarf Virus RepA gene stimulates cell cycle progression (G1/S transition) and cell division in maize (Gordon-Kamm et al., 2002, PNAS 99:11975-11980). Conversely, plant genes whose encoded products are known to inhibit the cell cycle have been shown to result in increased cell division when the gene, such as Cyclin-Dependent Kinase Inhibitor (ICK1/KRP), is down-regulated in *Arabidopsis* (Cheng et al 2013, Plant J 75:642-655). Thus, down-regulation of the KRP gene using an egg cell specific promoter to drive expression would be expected to have a similar effect as over-expression of DZ470, resulting in chromosome doubling. Methods of down-regulation of a gene such as KRP include expression of an artificial micro-RNA targeted to the KRP mRNA, or expression of a dCas9-repressor fusion that is targeted to the KRP promoter by a gRNA to that sequence. Finally, there are plant genes that are known to specifically impact the process of endoreduplication. When using such genes, such as for example the ccs52gene or the Dell gene, in the methods of the present disclosure, it is expected that over-expression of ccs52 would result in an increased ploidy level as observed in *Medicago sativa* (Cebolla et al., 1999, EMBO J 18:4476-4484), and that down-regulation of Dell would result in an increased ploidy level as observed in *Arabidopsis* (Vlieghe et al., 2005, Current Biol 15:59-63). It is expected that other genes that stimulate the cell cycle, the G1/S transition, or endoreduplication are used in the methods disclosed herein to increase ploidy level.

Repressor motifs include those disclosed in Kagale and Rozwadowski (Epigenetics. 2011. 6: 141-146). Ethylene-responsive element binding factor-associated Amphiphilic Repression (EAR) motif-mediated transcriptional repression is known in plants, including EAR motifs defined by the consensus sequence patterns of either LxLxL and DLNxxP (see Hiratsu et al., 2003. Plant J. 35:177-192). Peptides useful in the methods disclosed herein including, but not limited to, the amphiphilic repression motif disclosed in US20150197768A1A1 and all references cited therein and the Dr1/DRAP1 global repressor complex (see U.S. Pat. No. 7,288,695 B2 and all references cited therein), including the Dr1 motif that is similar to the motif found in *Arabidopsis thaliana* MYBL2 (see Matsui K, Umemura Y, Ohme-Takagi M. 2008. Plant J. 55:954-967).

Methods for creating haploid inducer lines include ectopically expressing AP2 domain containing transcription factors. For example, preferably the method of Gordon-Kamm et al. was used (see U.S. Pat. No. 7,579,529; the contents of which are hereby incorporated by reference).

The expression of the full length ZM-ODP2 peptide as described previously (see U.S. Pat. No. 7,579,529; the contents of which are hereby incorporated by reference) in useful in the methods disclosed herein. Additionally, the *Pennisetum squamulatum* AP2 transcription factor, Apospory-Specific-Genomic-Region BabyBoomLike (herein referred to as PsASGR-BBML) transgene can induce parthenogenesis and embryo formation without fertilization. In maize, individuals with a PsASGR-BBML transgene fertilized with pollen having the R1-navajo anthocyanin color markers exhibited haploid embryo production (Steffen J G, et al. 2007. Plant J 51:281-292, US2016/0304901 A1, herein incorporated by reference in their entirety). More recently, the method of Khanday and Sundaresan demonstrated similar findings, for example in rice (see WO2018/098420 A1; the contents of which are hereby incorporated by reference).

In an aspect, the methods disclosed herein are used to obtain an apomictic plant having inhibited or mutated gene products that induce mitosis instead of meiosis, the so-called “MiMe” phenotype (see US Patent Publication No. 2012/0042408 and US Patent Publication No. 2014/0298507, incorporated herein by reference in their entireties). The MiMe phenotype is induced by inhibiting or mutating proteins necessary for efficient meiotic recombination by eliminating recombination and/or pairing. For *Zea mays* methods that provide polynucleotides and related polypeptides of Spo11, Rec8, OSD1-1A, and OSD1-3A for suppressing their expression level or activity (see US 20190098858 A1, incorporated herein by reference in its entirety).

The methods of the present disclosure use transformation with such expression cassettes to obtain a fie (fertility-independent endosperm)-null genetic background to promote both de novo embryo development and endosperm development without fertilization. In addition, any of the variant ODP2 DNA sequences shown in Example 4 are delivered as described above into a homozygous zygotic-embryo-lethal genotype in which only the adventive embryos produced from somatic nucellus tissue develop in the seed. Apomictic seed is obtained in the absence of pollen using these methods to obtain a non-reduced gamete (apomeiosis).

Apomictic seed is obtained by providing to a plant cell capable of producing a non-reduced gamete the protein activities described in Example 4, wherein variant ODP2 peptides were shown to improve haploid parthenogenesis relative to a native Zm-ODP2 peptide. Apomictic seed is also obtained by providing to a plant cell capable of producing a non-reduced gamete the protein activities described in Example 10, wherein at least one variant ODP2 peptide is co-expressed in a cell where at least one parthenogenesis factor is repressed. It is expected that asexual reproduction is improved in comparison to a method using only the native ZM-ODP2 peptide (see U.S. Pat. No. 7,579,529 B2, incorporated herein by reference in its entirety).

In an aspect, translational fusion proteins useful in the methods disclosed herein, contain a recognition domain, for example a deactivated Cas alpha protein (dCasα) using a Cas peptide shown in Table 21, fused to a gene activation domain, for example such as those shown in Table 19, or fused to a gene repression domain, for example such as those shown in Table 22. Each expression cassette is operably linked to regulatory element that is expected to affect maternal haploid parthenogenesis, for example using a promoter such as those shown in Table 23. No effort is made herein to describe all possible combinations of such expression cassettes. It is expected the combined activity of these two expression cassettes simultaneously achieves altered gene expression in a plant cell, preferentially a female gamete cell, such as an egg cell. Particularly, such altered gene expression within an egg cell targets one group of loci to be up-regulated and a second group of loci to be down-regulated, thereby resulting in improved haploid parthenogenesis.

Exemplary genomic loci encoding gene products useful for targeted up-regulation comprise loci encoding morphological developmental genes and embryogenesis factors. For example, a morphogenic gene encoding a WUS/WOX homeobox polypeptide, or a Babyboom (BBM) polypeptide or an Ovule Development Protein 2 (ODP2) polypeptide, or a combination of thereof. In an aspect, the morphogenic gene encoding the WUS/WOX homeobox polypeptide is a WUS1, WUS2, WUS3, WOX2A, WOX4, WOX5, and WOX9 protein. In another aspect, the morphogenic gene encoding the Babyboom (BBM) polypeptide or the Ovule Development Protein 2 (ODP2) polypeptide is a Babyboom (BBM1), BBM2, BMN2, and BMN3 or the Ovule Development Protein 2 (ODP2) polypeptide.

Additional loci encoding other morphogenic genes useful for up-regulation in a female gamete, such as an egg cell, include, but are not limited to, LEC1 (U.S. Pat. No. 6,825,397 incorporated herein by reference in its entirety, Lotan et al., 1998, Cell 93:1195-1205), LEC2 (Stone et al., 2008, PNAS 105:3151-3156; Belide et al., 2013, Plant Cell Tiss. Organ Cult 113:543-553), KN1/STM (Sinha et al., 1993. Genes Dev 7:787-795), a homolog of MONOPTEROS-DELTA (Ckurshumova et al., 2014, New Phytol. 204:556-566), a homolog of the *Arabidopsis* SERK gene (Hecht et al., 2001, Plant Physiol. 127:803-816), a homolog of the *Arabidopsis* AGL15 gene (Harding et al., 2003, Plant Physiol. 133:653-663), or a homolog of the FUSCA gene (Castle and Meinke, Plant Cell 6:25-41). Additional loci encoding cellular reprogramming factors include embryogenesis factors described in WO2020214986A1, herein incorporated by reference in its entirety, useful herein for up-regulation in a female gamete, such as an egg cell.

Exemplary genomic loci encoding gene products useful for targeted gene repression comprise loci encoding repressors of morphological developmental genes. For example, repression target sites that are components of stem cell signaling pathways, such as CLV3, and the species-specific proteins thereof, a C2H2-type zinc finger protein repressing WUSCHEL, such as a KNUCKLES repressor protein, and a MADS-box transcription factor, such as AGAMOUS or a species-specific AGAMOUS-like ortholog are useful in the methods disclosed herein. Repression target sites include, but are not limited to, a genomic locus encoding a polycomb-group (PcG) protein, or subunit thereof, acting to repress expression of a genomic locus encoding a morphological developmental gene and/or an embryogenesis factor. Repression target sites that are members of the E(z) (Enhancer of Zeste) family, such as EZH1 and EZH2, of the Polycomb Repressive Complex 2 (PRC2), or any protein possessing histone methyltransferase activity with specificity for Lys 9 (K9) and Lys 27 (K27) of histone H3 (herein referred to as “H3K37me3”) are also useful in the methods disclosed herein. Additional repression target sites useful in the methods disclosed herein include, but are not limited to, a genomic locus encoding a CHD3 chromatin-remodeling factor, or subunit thereof, acting to repress expression of a genomic locus encoding a morphological developmental gene and/or an embryogenesis factor, including, but not limited to a homolog of the PICKLE gene (Ogas et al., 1999, PNAS 96:13839-13844).

The insertion of the polynucleotide at a desired genomic location is achieved using a site-specific recombination system. See, for example, WO99/25821, WO99/25854, WO99/25840, WO99/25855 and WO99/25853, all of which are herein incorporated by reference in their entirety. Briefly, a polynucleotide of interest, flanked by two non-identical recombination sites, is contained in a T-DNA transfer cassette. The T-DNA transfer cassette is introduced into a plant having stably incorporated into its genome a target site which is flanked by two non-identical recombination sites that correspond to the sites of the transfer cassette. An appropriate recombinase is provided, and the transfer cassette is integrated at the target site. The polynucleotide of interest is thereby integrated at a specific chromosomal position in the plant genome.

The disclosed methods are used to introduce into explants polynucleotides that are useful to target a specific site for modification in the genome of a plant derived from the explant. Site specific modifications that are introduced with the disclosed methods include those produced using any method for introducing site specific modification, including, but not limited to, through the use of gene repair oligonucleotides (e.g. US Publication 2013/0019349), or through the use of double-stranded break technologies such as TALENs, meganucleases, zinc finger nucleases, CRISPR-Cas, and the like. For example, the disclosed methods are used to introduce a CRISPR-Cas system into a plant cell or plant, for the purpose of genome modification of a target sequence in the genome of a plant or plant cell, for selecting plants, for deleting a base or a sequence, for gene editing, and for inserting a polynucleotide of interest into the genome of a plant or plant cell. Thus, the disclosed methods are used together with a CRISPR-Cas system to provide for an effective system for modifying or altering target sites and nucleotides of interest within the genome of a plant, plant cell or seed. The Cas endonuclease gene is a plant optimized Cas9 endonuclease, wherein the plant optimized Cas9 endonuclease is capable of binding to and creating a double strand break in a genomic target sequence of the plant genome.

The Cas endonuclease is guided by the guide nucleotide to recognize and optionally introduce a double strand break at a specific target site into the genome of a cell. The CRISPR-Cas system provides for an effective system for modifying target sites within the genome of a plant, plant cell or seed. Further provided are methods employing a guide polynucleotide/Cas endonuclease system to provide an effective system for modifying target sites within the genome of a cell and for editing a nucleotide sequence in the genome of a cell. Once a genomic target site is identified, a variety of methods is employed to further modify the target sites such that they contain a variety of polynucleotides of interest. The disclosed methods are used to introduce a CRISPR-Cas system for editing a nucleotide sequence in the genome of a cell. The nucleotide sequence to be edited (the nucleotide sequence of interest) is located within or outside a target site that is recognized by a Cas endonuclease.

CRISPR loci (Clustered Regularly Interspaced Short Palindromic Repeats) (also known as SPIDRs-SPacer Interspersed Direct Repeats) constitute a family of recently described DNA loci. CRISPR loci consist of short and highly conserved DNA repeats (typically 24 to 40 bp, repeated from 1 to 140 times—also referred to as CRISPR-repeats) which are partially palindromic. The repeated sequences (usually specific to a species) are interspaced by variable sequences of constant length (typically 20 to 58 by depending on the CRISPR locus (WO2007/025097 published Mar. 1, 2007).

Cas gene includes a gene that is generally coupled, associated or close to or in the vicinity of flanking CRISPR loci. The terms "Cas gene" and "CRISPR-associated (Cas) gene" are used interchangeably herein.

In another aspect, the Cas endonuclease gene is operably linked to a SV40 nuclear targeting signal upstream of the Cas codon region and a bipartite VirD2 nuclear localization signal (Tinland et al. (1992) Proc. Natl. Acad. Sci. USA 89:7442-6) downstream of the Cas codon region.

As related to the Cas endonuclease, the terms "functional fragment," "fragment that is functionally equivalent," and "functionally equivalent fragment" are used interchangeably herein. These terms refer to a portion or subsequence of the Cas endonuclease sequence in which the ability to create a double-strand break is retained.

As related to the Cas endonuclease, the terms "functional variant," "variant that is functionally equivalent" and "functionally equivalent variant" are used interchangeably herein. These terms refer to a variant of the Cas endonuclease in which the ability to create a double-strand break is retained. Fragments and variants are obtained via methods such as site-directed mutagenesis and synthetic construction.

In an aspect, the Cas endonuclease gene is a plant codon optimized *Streptococcus pyogenes* Cas9 gene that can recognize any genomic sequence of the form N(12-30)NGG which can in principle be targeted.

Endonucleases are enzymes that cleave the phosphodiester bond within a polynucleotide chain and include restriction endonucleases that cleave DNA at specific sites without damaging the bases. Restriction endonucleases include Type I, Type II, Type III, and Type IV endonucleases, which further include subtypes. In the Type I and Type III systems, both the methylase and restriction activities are contained in a single complex. Endonucleases also include meganucleases, also known as homing endonucleases (HEases), which like restriction endonucleases, bind and cut at a specific recognition site, however the recognition sites for meganucleases are typically longer, about 18 bp or more (Patent application PCT/US 12/30061 filed on Mar. 22, 2012). Meganucleases have been classified into four families based on conserved sequence motifs. These motifs participate in the coordination of metal ions and hydrolysis of phosphodiester bonds. Meganucleases are notable for their long recognition sites, and for tolerating some sequence polymorphisms in their DNA substrates. The naming convention for meganuclease is similar to the convention for other restriction endonuclease. Meganucleases are also characterized by prefix F-, I-, or PI- for enzymes encoded by free-standing ORFs, introns, and inteins, respectively. One step in the recombination process involves polynucleotide cleavage at or near the recognition site. This cleaving activity is used to produce a double-strand break. For reviews of site-specific recombinases and their recognition sites, see, Sauer (1994) Curr Op Biotechnol 5:521-7; and Sadowski (1993) FASEB 7:760-7. In some examples the recombinase is from the Integrase or Resolvase families. TAL effector nucleases are a new class of sequence-specific nucleases that are used to make double-strand breaks at specific target sequences in the genome of a plant or other organism. (Miller, et al. (2011) Nature Biotechnology 29:143-148). Zinc finger nucleases (ZFNs) are engineered double-strand break inducing agents comprised of a zinc finger DNA binding domain and a double-strand-break-inducing agent domain. Recognition site specificity is conferred by the zinc finger domain, which typically comprising two, three, or four zinc fingers, for example having a C2H2 structure, however other zinc finger structures are known and have been engineered. Zinc finger domains are amenable for designing polypeptides which specifically bind a selected polynucleotide recognition sequence. ZFNs include an engineered DNA-binding zinc finger domain linked to a nonspecific endonuclease domain, for example nuclease domain from a Type Ms endonuclease such as Fok1. Additional functionalities are fused to the zinc-finger binding domain, including transcriptional activator domains, transcription repressor domains, and methylases. In some examples, dimerization of nuclease domain is required for cleavage activity. Each zinc finger recognizes three consecutive base pairs in the target DNA. For example, a 3-finger domain recognized a sequence of 9 contiguous nucleotides, with a dimerization requirement of the nuclease, two sets of zinc finger triplets are used to bind an 18-nucleotide recognition sequence.

A "Dead-CAS9" (dCAS9) as used herein, is used to supply a transcriptional repressor domain. The dCAS9 has been mutated so that can no longer cut DNA. The dCAS0 can still bind when guided to a sequence by the gRNA and can also be fused to repressor elements. The dCAS9 fused to the repressor element, as described herein, is abbreviated to dCAS9~REP, where the repressor element (REP) is any repressor motif that have been characterized in plants. An expressed guide RNA (gRNA) binds to the dCAS9~REP protein and targets the binding of the dCAS9-REP fusion protein to a specific predetermined nucleotide sequence within a promoter (a promoter within the T-DNA). For example, if this is expressed beyond—the border using a ZM-UBI PRO::dCAS9~REP::PINII TERM cassette along with a U6-POL PRO::gRNA::U6 TERM cassette and the gRNA is designed to guide the dCAS9-REP protein to bind the SB-UBI promoter in the expression cassette SB-UBI PRO::moPAT::PINII TERM within the T-DNA, any event that has integrated the beyond-the-border sequence would be bialaphos sensitive. Transgenic events that integrate only the T-DNA would express moPAT and be bialaphos resistant. The advantage of using a dCAS9 protein fused to a repressor (as opposed to a TETR or ESR) is the ability to target these repressors to any promoter within the T-DNA. TETR and ESR are restricted to cognate operator binding sequences. Alternatively, a synthetic Zinc-Finger Nuclease fused to a repressor domain is used in place of the gRNA and dCAS9~REP (Urritia et al., 2003, Genome Biol. 4:231) as described above.

The type II CRISPR/Cas system from bacteria employs a crRNA and tracrRNA to guide the Cas endonuclease to its DNA target. The crRNA (CRISPR RNA) contains the region complementary to one strand of the double strand DNA target and base pairs with the tracrRNA (trans-activating CRISPR RNA) forming a RNA duplex that directs the Cas endonuclease to cleave the DNA target. As used herein, the term "guide nucleotide" relates to a synthetic fusion of two RNA molecules, a crRNA (CRISPR RNA) comprising a variable targeting domain, and a tracrRNA. In an aspect, the guide nucleotide comprises a variable targeting domain of 12 to 30 nucleotide sequences and a RNA fragment that can interact with a Cas endonuclease.

As used herein, the term "guide polynucleotide" relates to a polynucleotide sequence that can form a complex with a Cas endonuclease and enables the Cas endonuclease to recognize and optionally cleave a DNA target site. The guide polynucleotide is a single molecule or a double molecule. The guide polynucleotide sequence is a RNA sequence, a DNA sequence, or a combination thereof (a RNA-DNA combination sequence). Optionally, the guide polynucleotide can comprise at least one nucleotide, phosphodiester bond or linkage modification such as, but not limited, to Locked Nucleic Acid (LNA), 5-methyl dC, 2,6-Diaminopurine, 2'-Fluoro A, 2'-Fluoro U, 2'-O-Methyl RNA, phosphorothioate bond, linkage to a cholesterol molecule, linkage to a polyethylene glycol molecule, linkage to a spacer 18 (hexaethylene glycol chain) molecule, or 5' to 3' covalent linkage resulting in circularization. A guide polynucleotide that solely comprises ribonucleic acids is also referred to as a "guide nucleotide".

Nucleotide sequence modification of the guide polynucleotide, VT domain and/or CER domain is selected from, but not limited to, the group consisting of a 5' cap, a 3' polyadenylated tail, a riboswitch sequence, a stability control sequence, a sequence that forms a dsRNA duplex, a modification or sequence that targets the guide poly nucleotide to a subcellular location, a modification or sequence that provides for tracking, a modification or sequence that provides a binding site for proteins, a Locked Nucleic Acid (LNA), a 5-methyl dC nucleotide, a 2,6-Diaminopurine nucleotide, a 2'-Fluoro A nucleotide, a 2'-Fluoro U nucleotide; a 2'-O-Methyl RNA nucleotide, a phosphorothioate bond, linkage to a cholesterol molecule, linkage to a polyethylene glycol molecule, linkage to a spacer 18 molecule, a 5' to 3' covalent linkage, or any combination thereof. These modifications can result in at least one additional beneficial feature, wherein the additional beneficial feature is selected from the group of a modified or regulated stability, a subcellular targeting, tracking, a fluorescent label, a binding site for a protein or protein complex, modified binding affinity to complementary target sequence, modified resistance to cellular degradation, and increased cellular permeability.

In an aspect, the guide nucleotide and Cas endonuclease are capable of forming a complex that enables the Cas endonuclease to introduce a double strand break at a DNA target site.

In an aspect of the present disclosure the variable target domain is 12, 13, 14, 15, 16, 17, 18, 19, 20, 21, 22, 23, 24, 25, 26, 27, 28, 29 or 30 nucleotides in length.

In an aspect of the present disclosure, the guide nucleotide comprises a cRNA (or cRNA fragment) and a tracrRNA (or tracrRNA fragment) of the type II CRISPR/Cas system that can form a complex with a type II Cas endonuclease, wherein the guide nucleotide Cas endonuclease complex can direct the Cas endonuclease to a plant genomic target site, enabling the Cas endonuclease to introduce a double strand break into the genomic target site. The guide nucleotide is introduced into a plant or plant cell directly using any method including, but not limited to, particle bombardment or topical applications.

In an aspect, the guide nucleotide is introduced indirectly by introducing a recombinant DNA molecule comprising the corresponding guide DNA sequence operably linked to a plant specific promoter that is capable of transcribing the guide nucleotide in the plant cell. The term "corresponding guide DNA" includes a DNA molecule that is identical to the RNA molecule but has a "T" substituted for each "U" of the RNA molecule.

In an aspect, the guide nucleotide is introduced via particle bombardment or using the disclosed methods for *Agrobacterium* transformation of a recombinant DNA construct comprising the corresponding guide DNA operably linked to a plant U6 polymerase III promoter.

In an aspect, the RNA that guides the RNA Cas9 endonuclease complex, is a duplexed RNA comprising a duplex crRNA-tracrRNA. One advantage of using a guide nucleotide versus a duplexed crRNA-tracrRNA is that only one expression cassette needs to be made to express the fused guide nucleotide.

The terms "target site," "target sequence," "target DNA," "target locus," "genomic target site," "genomic target sequence," and "genomic target locus" are used interchangeably herein and refer to a polynucleotide sequence in the genome (including chloroplastic and mitochondrial DNA) of a plant cell at which a double-strand break is induced in the plant cell genome by a Cas endonuclease. The target site is an endogenous site in the plant genome, or alternatively, the target site is heterologous to the plant and thereby not be naturally occurring in the genome, or the target site is found in a heterologous genomic location compared to where it occurs in nature.

As used herein, terms "endogenous target sequence" and "native target sequence" are used interchangeably herein to refer to a target sequence that is endogenous or native to the genome of a plant and is at the endogenous or native position of that target sequence in the genome of the plant.

An "artificial target site" or "artificial target sequence" are used interchangeably herein and refer to a target sequence that has been introduced into the genome of a plant. Such an artificial target sequence is identical in sequence to an endogenous or native target sequence in the genome of a plant but be located in a different position (i.e., a non-endogenous or non-native position) in the genome of a plant.

An "altered target site," "altered target sequence" "modified target site," and "modified target sequence" are used interchangeably herein and refer to a target sequence as disclosed herein that comprises at least one alteration when compared to non-altered target sequence. Such "alterations" include, for example: (i) replacement of at least one nucleotide, (ii) a deletion of at least one nucleotide, (iii) an insertion of at least one nucleotide, or (iv) any combination of (i)-(iii).

In an aspect, the disclosed methods are used to introduce into plants polynucleotides useful for gene suppression of a target gene in a plant. Reduction of the activity of specific genes (also known as gene silencing, or gene suppression) is desirable for several aspects of genetic engineering in plants. Techniques for gene silencing include antisense technology.

In an aspect, the disclosed methods are used to introduce into plants polynucleotides useful for the targeted integration of nucleotide sequences into a plant. For example, the disclosed methods are used to introduce T-DNA expression cassettes comprising nucleotide sequences of interest flanked by non-identical recombination sites are used to transform a plant comprising a target site. In an aspect, the target site contains at least a set of non-identical recombination sites corresponding to those on the T-DNA expression cassette. The exchange of the nucleotide sequences flanked by the recombination sites is affected by a recombinase. Thus, the disclosed methods are used for the introduction of T-DNA expression cassettes for targeted integration of nucleotide sequences, wherein the T-DNA expression cassettes which are flanked by non-identical recombination sites recognized by a recombinase that recognizes and implements recombination at the non-identical recombination sites. Accordingly, the disclosed methods and composition are used to improve efficiency and speed of development of plants containing non-identical recombination sites.

Thus, the disclosed methods can further comprise methods for the directional, targeted integration of exogenous nucleotides into a transformed plant. In an aspect, the disclosed methods use recombination sites in a gene targeting system which facilitates directional targeting of desired genes and nucleotide sequences into corresponding recombination sites previously introduced into the target plant genome.

In an aspect, a nucleotide sequence flanked by two non-identical recombination sites is introduced into one or more cells of an explant derived from the target organism's genome establishing a target site for insertion of nucleotide sequences of interest. Once a stable plant or cultured tissue is established a second construct, or nucleotide sequence of interest, flanked by corresponding recombination sites as those flanking the target site, is introduced into the stably transformed plant or tissues in the presence of a recombinase protein. This process results in exchange of the nucleotide sequences between the non-identical recombination sites of the target site and the T-DNA expression cassette.

It is recognized that the transformed plant prepared in this manner may comprise multiple target sites; i. e., sets of non-identical recombination sites. In this manner, multiple manipulations of the target site in the transformed plant are available. By target site in the transformed plant is intended a DNA sequence that has been inserted into the transformed plant's genome and comprises non-identical recombination sites.

Examples of recombination sites for use in the disclosed method are known. The two-micron plasmid found in most naturally occurring strains of *Saccharomyces cerevisiae*, encodes a site-specific recombinase that promotes an inversion of the DNA between two inverted repeats. This inversion plays a central role in plasmid copy-number amplification.

The protein, designated FLP protein, catalyzes site-specific recombination events. The minimal recombination site (FRT) has been defined and contains two inverted 13-base pair (bp) repeats surrounding an asymmetric 8-bp spacer. The FLP protein cleaves the site at the junctions of the repeats and the spacer and is covalently linked to the DNA via a 3' phosphate. Site specific recombinases like FLP cleave and relegate DNA at specific target sequences, resulting in a precisely defined recombination between two identical sites. To function, the system needs the recombination sites and the recombinase. No auxiliary factors are needed. Thus, the entire system is inserted into and functions in plant cells. The yeast FLP\FRT site specific recombination system has been shown to function in plants. To date, the system has been utilized for excision of unwanted DNA. See, Lyznik et at. (1993) Nucleic Acid Res. 21: 969-975. In contrast, the present disclosure utilizes non-identical FRTs for the exchange, targeting, arrangement, insertion and control of expression of nucleotide sequences in the plant genome.

In an aspect, a transformed organism of interest, such as an explant from a plant, containing a target site integrated into its genome is needed. The target site is characterized by being flanked by non-identical recombination sites. A targeting cassette is additionally required containing a nucleotide sequence flanked by corresponding non-identical recombination sites as those sites contained in the target site of the transformed organism. A recombinase which recognizes the non-identical recombination sites and catalyzes site-specific recombination is required.

It is recognized that the recombinase is provided by any means. That is, it is provided in the organism or plant cell by transforming the organism with an expression cassette capable of expressing the recombinase in the organism, by transient expression, or by providing messenger RNA (mRNA) for the recombinase or the recombinase protein.

By "non-identical recombination sites" it is intended that the flanking recombination sites are not identical in sequence and will not recombine or recombination between the sites is minimal. That is, one flanking recombination site may be a FRT site where the second recombination site may be a mutated FRT site. The non-identical recombination sites used in the methods of the present disclosure prevent or greatly suppress recombination between the two flanking recombination sites and excision of the nucleotide sequence contained therein. Accordingly, it is recognized that any suitable non-identical recombination sites may be utilized in the present disclosure, including, but not limited to, FRT and mutant FRT sites, FRT and lox sites, lox and mutant lox sites.

By suitable non-identical recombination site implies that in the presence of active recombinase, excision of sequences between two non-identical recombination sites occurs, if at all, with an efficiency considerably lower than the recombinationally-mediated exchange targeting arrangement of nucleotide sequences into the plant genome. Thus, suitable non-identical sites for use in the present disclosure include those sites where the efficiency of recombination between the sites is low; for example, where the efficiency is less than about 30 to about 50%, preferably less than about 10 to about 30%, more preferably less than about 5 to about 10%.

As noted above, the recombination sites in the targeting cassette correspond to those in the target site of the transformed plant. That is, if the target site of the transformed plant contains flanking non-identical recombination sites of FRT and a mutant FRT, the targeting cassette will contain the same FRT and mutant FRT non-identical recombination sites.

It is furthermore recognized that the recombinase, which is used in the disclosed methods, will depend upon the recombination sites in the target site of the transformed plant and the targeting cassette. That is, if FRT sites are utilized, the FLP recombinase is needed. In the same manner, where lox sites are utilized, the Cre recombinase is required. If the non-identical recombination sites comprise both a FRT and a lox site, both the FLP and Cre recombinase is required in the plant cell.

The FLP recombinase is a protein which catalyzes a site-specific reaction that is involved in amplifying the copy number of the two-micron plasmid of *S. cerevisiae* during DNA replication. FLP protein has been cloned and expressed. See, for example, Cox (1993) Proc. Natl. Acad. Sci. U.S.A 80: 4223-4227. The FLP recombinase for use in the present disclosure may be that derived from the genus *Saccharomyces*. It may be preferable to synthesize the recombinase using plant preferred codons for optimum expression in a plant of interest. See, for example, U.S. application Ser. No. 08/972,258 filed Nov. 18, 1997, entitled "Novel Nucleic Acid Sequence Encoding FLP Recombinase," herein incorporated by reference.

The bacteriophage recombinase Cre catalyzes site-specific recombination between two lox sites. See, for example, Guo et al. (1997) Nature 389: 40-46; Abremski et al. (1984) J. Biol. Chem. 259: 1509-1514; Chen et al. (1996) Somat. Cell Mol. Genet. 22: 477-488; and Shaikh et al. (1977) J. Biol. Chem. 272: 5695-5702. All of which are herein incorporated by reference. Such Cre sequence may also be synthesized using plant preferred codons.

Where appropriate, the nucleotide sequences to be inserted in the plant genome may be optimized for increased expression in the transformed plant. Where mammalian, yeast, or bacterial genes are used in the present disclosure, they are synthesized using plant preferred codons for improved expression. It is recognized that for expression in monocots, dicot genes can also be synthesized using monocot preferred codons. Methods are available for synthesizing plant preferred genes. See, for example, U.S. Pat. Nos. 5,380,831, 5,436,391, and Murray et al. (1989) Nucleic Acids Res. 17: 477-498, herein incorporated by reference. The plant preferred codons may be determined from the codons utilized more frequently in the proteins expressed in the plant of interest. It is recognized that monocot or dicot preferred sequences may be constructed as well as plant preferred sequences for particular plant species. See, for example, EPA 0359472; EPA 0385962; WO 91/16432; Perlak et al. (1991) Proc. Natl. Acad. Sci. USA, 88: 3324-3328; and Murray et al. (1989) Nucleic Acids Research, 17: 477-498. U.S. Pat. Nos. 5,380,831; 5,436,391; and the like, herein incorporated by reference. It is further recognized that all or any part of the gene sequence may be optimized or synthetic. That is, fully optimized or partially optimized sequences may also be used.

Additional sequence modifications are known to enhance gene expression in a cellular host and are used in the present disclosure. These include elimination of sequences encoding spurious polyadenylation signals, exon-intron splice site signals, transposon-like repeats, and other such well-characterized sequences, which may be deleterious to gene expression. The G-C content of the sequence may be adjusted to levels average for a given cellular host, as calculated by reference to known genes expressed in the host cell. When possible, the sequence is modified to avoid predicted hairpin secondary RNA structures.

The present disclosure also encompasses FLP recombination target sites (FRT). The FRT has been identified as a minimal sequence comprising two 13 base pair repeats, separated by an eight (8) base spacer. The nucleotides in the spacer region are replaced with a combination of nucleotides, so long as the two 13-base repeats are separated by eight nucleotides. It appears that the actual nucleotide sequence of the spacer is not critical; however, for the practice of the present disclosure, some substitutions of nucleotides in the space region may work better than others. The eight-base pair spacer is involved in DNA-DNA pairing during strand exchange. The asymmetry of the region determines the direction of site alignment in the recombination event, which will subsequently lead to either inversion or excision. As indicated above, most of the spacer can be mutated without a loss of function. See, for example, Schlake and Bode (1994) Biochemistry 33: 12746-12751, herein incorporated by reference.

FRT mutant sites are used in the practice of the disclosed methods. Such mutant sites may be constructed by PCR-based mutagenesis. Although mutant FRT sites are known (see SEQ ID NO: 2, 3, 4 and 5 of WO1999/025821), it is recognized that other mutant FRT sites may be used in the practice of the present disclosure. The present disclosure is not restricted to the use of a particular FRT or recombination site, but rather that non-identical recombination sites or FRT sites are utilized for targeted insertion and expression of nucleotide sequences in a plant genome. Thus, other mutant FRT sites are constructed and utilized based upon the present disclosure.

As discussed above, bringing genomic DNA containing a target site with non-identical recombination sites together with a vector containing a T-DNA expression cassette with corresponding non-identical recombination sites, in the presence of the recombinase, results in recombination. The nucleotide sequence of the T-DNA expression cassette located between the flanking recombination sites is exchanged with the nucleotide sequence of the target site located between the flanking recombination sites. In this manner, nucleotide sequences of interest may be precisely incorporated into the genome of the host.

It is recognized that many variations of the present disclosure can be practiced. For example, target sites can be constructed having multiple non-identical recombination sites. Thus, multiple genes or nucleotide sequences can be stacked or ordered at precise locations in the plant genome. Likewise, once a target site has been established within the genome, additional recombination sites may be introduced by incorporating such sites within the nucleotide sequence of the T-DNA expression cassette and the transfer of the sites to the target sequence. Thus, once a target site has been established, it is possible to subsequently add sites, or alter sites through recombination.

Another variation includes providing a promoter or transcription initiation region operably linked with the target site in an organism. Preferably, the promoter is 5' to the first recombination site. By transforming the organism with a T-DNA expression cassette comprising a coding region, expression of the coding region will occur upon integration of the T-DNA expression cassette into the target site. This aspect provides for a method to select transformed cells, particularly plant cells, by providing a selectable marker sequence as the coding sequence.

Other advantages of the present system include the ability to reduce the complexity of integration of transgenes or transferred DNA in an organism by utilizing T-DNA expression cassettes as discussed above and selecting organisms with simple integration patterns. In the same manner, preferred sites within the genome are identified by comparing several transformation events. A preferred site within the genome includes one that does not disrupt expression of essential sequences and provides for adequate expression of the transgene sequence.

The following examples are offered by way of illustration and not by way of limitation.

EXAMPLES

The aspects of the disclosure are further defined in the following Examples, in which parts and percentages are by weight and degrees are Celsius, unless otherwise stated. These Examples, while indicating aspects of the disclosure, are given by way of illustration only.

From the above discussion and these Examples, one skilled in the art can ascertain the essential characteristics of the aspects of the disclosure, and without departing from the spirit and scope thereof, can make various changes and modifications of them to adapt to various usages and conditions. Thus, various modifications in addition to those shown and described herein will be apparent to those skilled in the art from the foregoing description. Such modifications are also intended to fall within the scope of the appended claims.

Example 1: Plasmids

See Table 2 for a description of plasmids useful in the present disclosure.

TABLE 2

| SEQ ID NO: | Plasmid | Plasmid Elements |
|---|---|---|
| 21 | PHP94831 | RB + SB-ALS PRO:ZM-ALS (HRA) EXON1::ST-LS1 INTRON2 FRAG1 + LOXP + ZM-AXIG1 1XOP-B PRO-V1::ZM-WUS2 (CDNA)::IN2-1 TERM + AT-5-IV-2 INS + ATTB1 + ZM-PLTP PRO::ZM-PLTP 5 UTR::ZM-ODP2 (ALT1)::OS-T28 TERM::PINII TERM::CZ19B1 TERM + ALL STOPS2 + ZM-GLB1 PRO::MO-CRE EXON1::ST-LS1 INTRON2-V2::MO-CRE EXON2::PINII TERM-V3 + SB-UBI PRO::SB-UBI INTRON1::ZS-GREEN1::OS-UBI TERM + MINI-ALLSTOPS + LOXP + ZM-ALS (HRA) EXON2::SB-PEPC1 TERM (MOD1) + PV-EGG CELL PRO (TR1):PV-PRO31696.1 5UTR:EGG MIN PRO::ZM-ODP2::PINII TERM + LB |
| 22 | PHP92900 | RB + SB-ALS PRO::ZM-ALS (HRA) EXON1::ST-LS1 INTRON2 FRAG1 + LOXP + ZM-AXIG1 1XOP-B PRO-V1::ZM-WUS2 (CDNA)::IN2-1 TERM + AT-5-IV-2 INS + ATTB1 + ZM-PLTP PRO::ZM-PLTP 5 UTR::ZM-ODP2 (ALT1)::OS-T28 TERM::PINII TERM::CZ19B1 TERM + ALL STOPS2 + ZM-GLB 1 PRO::MO-CRE EXON1::ST-LS1 INTRON2-V2::MO-CRE EXON2::PINII TERM-V3 + SB-UBI PRO::SB-UBI INTRON1::ZS-GREEN1::OS-UBI TERM + MINI-ALLSTOPS + LOXP + ZM-ALS (HRA) EXON2::SB-PEPC1 TERM (MOD1) + PV-EGG CELL PRO (TR1):PV-PRO31696.1 5UTR:EGG MIN PRO::ZM-ODP2 (TR5)::PINII TERM + LB |
| 23 | RV036687 | RB + SB-ALS PRO::ZM-ALS (HRA) EXON1::ST-LS1 INTRON2 FRAG1 + LOXP + ZM-AXIG1 1XOP-B PRO-V1::ZM-WUS2 (CDNA)::IN2-1 TERM + AT-5-IV-2 INS + ATTB1 + ZM-PLTP PRO::ZM-PLTP 5 UTR::ZM-ODP2 (ALT1)::OS-T28 TERM::PINII TERM::CZ19B1 TERM + ALL STOPS2 + ZM-GLB 1 PRO::MO-CRE EXON1::ST-LS1 INTRON2-V2::MO-CRE EXON2::PINII TERM-V3 + SB-UBI PRO::SB-UBI INTRON1::ZS-GREEN1::OS-UBI TERM + MINI-ALLSTOPS + LOXP + ZM-ALS (HRA) EXON2::SB-PEPC1 TERM (MOD1) + PV-EGG CELL PRO (TR1):PV-PRO31696.1 5UTR:EGG MIN PRO:: ZM-ODP2 (TR6)_PROTEIN LINKER 1_ZM-ODP2 (TR7)::PINII TERM + LB |
| 24 | RV036691 | RB + SB-ALS PRO::ZM-ALS (HRA) EXON1::ST-LS1 INTRON2 FRAG1 + LOXP + ZM-AXIG1 1XOP-B PRO-V1::ZM-WUS2 (CDNA)::IN2-1 TERM + AT-5-IV-2 INS + ATTB1 + ZM-PLTP PRO::ZM-PLTP 5 UTR::ZM-ODP2 (ALT1)::OS-T28 TERM::PINII TERM::CZ19B1 TERM + ALL STOPS2 + ZM-GLB1 PRO::MO-CRE EXON1::ST-LS1 INTRON2-V2::MO-CRE EXON2::PINII TERM-V3 + SB-UBI PRO::SB-UBI INTRON1::ZS-GREEN1::OS-UBI TERM + MINI-ALLSTOPS + LOXP + ZM-ALS (HRA) EXON2::SB-PEPC1 TERM (MOD1) + PV-EGG CELL PRO (TR1):PV-PRO31696.1 5UTR:EGG MIN PRO:: ZM-ODP2 (TR4)-V2::PINII TERM + LB |

TABLE 2-continued

| SEQ ID NO: | Plasmid | Plasmid Elements |
|---|---|---|
| 25 | RV036689 | RB + SB-ALS PRO::ZM-ALS (HRA) EXON1::ST-LS1 INTRON2 FRAG1 + LOXP + ZM-AXIG1 1XOP-B PRO-V1::ZM-WUS2 (CDNA)::IN2-1 TERM + AT-5-IV-2 INS + ATTB1 + ZM-PLTP PRO::ZM-PLTP 5 UTR::ZM-ODP2 (ALT1)::OS-T28 TERM::PINII TERM::CZ19B1 TERM + ALL STOPS2 + ZM-GLB1 PRO::MO-CRE EXON1::ST-LS1 INTRON2-V2::MO-CRE EXON2::PINII TERM-V3 + SB-UBI PRO::SB-UBI INTRON1::ZS-GREEN1::OS-UBI TERM + MINI-ALLSTOPS + LOXP + ZM-ALS (HRA) EXON2::SB-PEPC1 TERM (MOD1) + PV-EGG CELL PRO (TR1):PV-PRO31696.1 5UTR:EGG MIN PRO:: ZM-ODP2 (TR9)::PINII TERM + LB |
| 26 | RV036690 | RB + SB-ALS PRO::ZM-ALS (HRA) EXON1::ST-LS1 INTRON2 FRAG1 + LOXP + ZM-AXIG1 1XOP-B PRO-V1::ZM-WUS2 (CDNA)::IN2-1 TERM + AT-5-IV-2 INS + ATTB1 + ZM-PLTP PRO::ZM-PLTP 5 UTR::ZM-ODP2 (ALT1)::OS-T28 TERM::PINII TERM::CZ19B1 TERM + ALL STOPS2 + ZM-GLB1 PRO::MO-CRE EXON1::ST-LS1 INTRON2-V2::MO-CRE EXON2::PINII TERM-V3 + SB-UBI PRO::SB-UBI INTRON1::ZS-GREEN1::OS-UBI TERM + MINI-ALLSTOPS + LOXP + ZM-ALS (HRA) EXON2::SB-PEPC1 TERM (MOD1) + PV-EGG CELL PRO (TR1):PV-PRO31696.1 5UTR:EGG MIN PRO:: ZM-ODP2 (TR10)::PINII TERM + LB |
| 27 | RV036688 | RB + SB-ALS PRO:ZM-ALS (HRA) EXON1::ST-LS1 INTRON2 FRAG1 + LOXP + ZM-AXIG1 1XOP-B PRO-V1::ZM-WUS2 (CDNA)::IN2-1 TERM + AT-5-IV-2 INS + ATTB1 + ZM-PLTP PRO::ZM-PLTP 5 UTR::ZM-ODP2 (ALT1)::OS-T28 TERM::PINII TERM::CZ19B1 TERM + ALL STOPS2 + ZM-GLB1 PRO::MO-CRE EXON1::ST-LS1 INTRON2-V2::MO-CRE EXON2::PINII TERM-V3 + SB-UBI PRO::SB-UBI INTRON1::ZS-GREEN1::OS-UBI TERM + MINI-ALLSTOPS + LOXP + ZM-ALS (HRA) EXON2::SB-PEPC1 TERM (MOD1) + PV-EGG CELL PRO (TR1):PV-PRO31696.1 5UTR:EGG MIN PRO:: ZM-ODP2 (TR8)::PINII TERM + LB |
| 28 | RV036694 | RB + SB-ALS PRO::ZM-ALS (HRA) EXON1::ST-LS1 INTRON2 FRAG1 + LOXP + ZM-AXIG1 1XOP-B PRO-V1::ZM-WUS2 (CDNA)::IN2-1 TERM + AT-5-IV-2 INS + ATTB1 + ZM-PLTP PRO::ZM-PLTP 5 UTR::ZM-ODP2 (ALT1)::OS-T28 TERM::PINII TERM::CZ19B1 TERM + ALL STOPS2 + ZM-GLB1 PRO::MO-CRE EXON1::ST-LS1 INTRON2-V2::MO-CRE EXON2::PINII TERM-V3 + SB-UBI PRO::SB-UBI INTRON1::ZS-GREEN1::OS-UBI TERM + MINI-ALLSTOPS + LOXP + ZM-ALS (HRA) EXON2::SB-PEPC1 TERM (MOD1) + PV-EGG CELL PRO (TR1):PV-PRO31696.1 5UTR:EGG MIN PRO:: ZM-ODP2 (TR5)-V2::PINII TERM + LB |
| 29 | RV036693 | RB + SB-ALS PRO:ZM-ALS (HRA) EXON1::ST-LS1 INTRON2 FRAG1 + LOXP + ZM-AXIG1 1XOP-B PRO-V1::ZM-WUS2 (CDNA)::IN2-1 TERM + AT-5-IV-2 INS + ATTB1 + ZM-PLTP PRO::ZM-PLTP 5 UTR::ZM-ODP2 (ALT1)::OS-T28 TERM::PINII TERM::CZ19B1 TERM + ALL STOPS2 + ZM-GLB1 PRO::MO-CRE EXON1::ST-LS1 INTRON2-V2::MO-CRE EXON2::PINII TERM-V3 + SB-UBI PRO::SB-UBI INTRON1::ZS-GREEN1::OS-UBI TERM + MINI-ALLSTOPS + LOXP + ZM-ALS (HRA) EXON2::SB-PEPC1 TERM (MOD1) + PV-EGG CELL PRO (TR1):PV-PRO31696.1 5UTR:EGG MIN PRO:: ZM-ODP2 (TR11)_PROTEIN LINKER 1_ZM-ODP2 (TR5)-V2::PINII TERM + LB |
| 30 | RV036695 | RB + SB-ALS PRO::ZM-ALS (HRA) EXON1::ST-LS1 INTRON2 FRAG1 + LOXP + ZM-AXIG1 1XOP-B PRO-V1::ZM-WUS2 (CDNA)::IN2-1 TERM + AT-5-IV-2 INS + ATTB1 + ZM-PLTP PRO::ZM-PLTP 5 UTR::ZM-ODP2 (ALT1)::OS-T28 TERM::PINII TERM::CZ19B1 TERM + ALL STOPS2 + ZM-GLB 1 PRO::MO-CRE EXON1::ST-LS1 INTRON2-V2::MO-CRE EXON2::PINII TERM-V3 + SB-UBI PRO::SB-UBI INTRON1::ZS-GREEN1::OS-UBI TERM + MINI-ALLSTOPS + LOXP + ZM-ALS (HRA) EXON2::SB-PEPC1 TERM (MOD1) + PV-EGG CELL PRO (TR1):PV-PRO31696.1 5UTR:EGG MIN PRO:: ZM-ODP2 (TR12)_PROTEIN LINKER 1_ZM-ODP2 (TR5)-V2::PINII TERM + LB |
| 112 | RV035609 | RB + MINI-ALLSTOPS3 + PSA2 + SB-ALS PRO::ZM-ALS (HRA) EXON1 + LOXP + ZM-AXIG1 1XOP-B PRO-V1::ZM-WUS2 (CDNA)::IN2-1 TERM-V3 + AT-5-IV-2 INS + ATTB1 + ZM-PLTP PRO::ZM-PLTP 5 UTR::ZM-ODP2 (ALT1)::OS-T28 TERM PINII TERM + CZ19B1 TERM + ALL STOPS2 + ZM-GLB1 PRO::MO-CRE EXON1::ST-LS1 INTRON2-V2::MO-CRE EXON2 + ATTB2 + PINII TERM-V3 + SB-UBI PRO::SB-UBI INTRON1::ZS-GREEN1::OS-UBI TERM + MINI-ALLSTOPS + LOXP + ZM-ALS (HRA) EXON2::SB-PEPC1 TERM (MOD1) + AT-RPG ELEMENT-V3 + ATTB4 + PV-EGG CELL PRO (TR1):EGG MIN PRO:PV- |

TABLE 2-continued

| SEQ ID NO: | Plasmid | Plasmid Elements |
|---|---|---|
| | | PRO31696.1 5UTR::ZM-ODP2 (TR5)-V1:TAV-T2A (MO1):ZM-CYCD2::PINII TERM + ATTB3 + PSB1 + MINI-ALLSTOPS4 + LB |
| 113 | RX000001 | RB + MINI-ALLSTOPS3 + PSA2 + SB-ALS PRO::ZM-ALS (HRA) EXON1 + LOXP + ZM-AXIG1 1XOP-B PRO-V1::ZM-WUS2 (CDNA)::IN2-1 TERM-V3 + AT-5-IV-2 INS + ATTB1 + ZM-PLTP PRO::ZM-PLTP 5 UTR::ZM-ODP2 (ALT1)::OS-T28 TERM PINII TERM + CZ19B1 TERM + ALL STOPS2 + ZM-GLB1 PRO::MO-CRE EXON1::ST-LS1 INTRON2-V2::MO-CRE EXON2 + ATTB2 + PINII TERM-V3 + SB-UBI PRO::SB-UBI INTRON1::ZS-GREEN1::OS-UBI TERM + MINI-ALLSTOPS + LOXP + ZM-ALS (HRA) EXON2::SB-PEPC1 TERM (MOD1) + AT-RPG ELEMENT-V3 + ATTB4 + PV-EGG CELL PRO (TR1):EGG MIN PRO:PV-PRO31696.1 5UTR:: ZM-ODP2 (TR9):TAV-T2A (MO1):ZM-CYCD2::PINII TERM + ATTB3 + PSB1 + MINI-ALLSTOPS4 + LB |
| 114 | RX000002 | RB + MINI-ALLSTOPS3 + PSA2 + SB-ALS PRO::ZM-ALS (HRA) EXON1 + LOXP + ZM-AXIG1 1XOP-B PRO-V1::ZM-WUS2 (CDNA)::IN2-1 TERM-V3 + AT-5-IV-2 INS + ATTB1 + ZM-PLTP PRO::ZM-PLTP 5 UTR::ZM-ODP2 (ALT1)::OS-T28 TERM_PINII TERM + CZ19B1 TERM + ALL STOPS2 + ZM-GLB1 PRO::MO-CRE EXON1::ST-LS1 INTRON2-V2::MO-CRE EXON2 + ATTB2 + PINII TERM-V3 + SB-UBI PRO::SB-UBI INTRON1::ZS-GREEN1::OS-UBI TERM + MINI-ALLSTOPS + LOXP + ZM-ALS (HRA) EXON2::SB-PEPC1 TERM (MOD1) + AT-RPG ELEMENT-V3 + ATTB4 + PV-EGG CELL PRO (TR1):EGG MIN PRO:PV-PRO31696.1 5UTR:: ZM-ODP2 (TR10):TAV-T2A (MO1):ZM-CYCD2::PINII TERM + ATTB3 + PSB1 + MINI-ALLSTOPS4 + LB |
| 115 | RX000003 | RB + MINI-ALLSTOPS3 + PSA2 + SB-ALS PRO::ZM-ALS (HRA) EXON1 + LOXP + ZM-AXIG1 1XOP-B PRO-V1::ZM-WUS2 (CDNA)::IN2-1 TERM-V3 + AT-5-IV-2 INS + ATTB1 + ZM-PLTP PRO::ZM-PLTP 5 UTR::ZM-ODP2 (ALT1)::OS-T28 TERM_PINII TERM + CZ19B1 TERM + ALL STOPS2 + ZM-GLB1 PRO::MO-CRE EXON1::ST-LS1 INTRON2-V2::MO-CRE EXON2 + ATTB2 + PINII TERM-V3 + SB-UBI PRO::SB-UBI INTRON1::ZS-GREEN1::OS-UBI TERM + MINI-ALLSTOPS + LOXP + ZM-ALS (HRA) EXON2::SB-PEPC1 TERM (MOD1) + AT-RPG ELEMENT-V3 + ATTB4 + PV-EGG CELL PRO (TR1):EGG MIN PRO:PV-PRO31696.1 5UTR::ZM-ODP2 (TR8):TAV-T2A (MO1):ZM-CYCD2::PINII TERM + ATTB3 + PSB1 + MINI-ALLSTOPS4 + LB |
| 116 | RX000004 | RB + MINI-ALLSTOPS3 + PSA2 + SB-ALS PRO::ZM-ALS (HRA) EXON1 + LOXP + ZM-AXIG1 1XOP-B PRO-V1::ZM-WUS2 (CDNA)::IN2-1 TERM-V3 + AT-5-IV-2 INS + ATTB1 + ZM-PLTP PRO::ZM-PLTP 5 UTR::ZM-ODP2 (ALT1)::OS-T28 TERM_PINII TERM + CZ19B1 TERM + ALL STOPS2 + ZM-GLB1 PRO::MO-CRE EXON1::ST-LS1 INTRON2-V2::MO-CRE EXON2 + ATTB2 + PINII TERM-V3 + SB-UBI PRO::SB-UBI INTRON1::ZS-GREEN1::OS-UBI TERM + MINI-ALLSTOPS + LOXP + ZM-ALS (HRA) EXON2::SB-PEPC1 TERM (MOD1) + AT-RPG ELEMENT-V3 + ATTB4 + PV-EGG CELL PRO (TR1):EGG MIN PRO:PV-PRO31696.1 5UTR:: ZM-ODP2 (TR5)-V2:TAV-T2A (MO1):ZM-CYCD2::PINII TERM + ATTB3 + PSB1 + MINI-ALLSTOPS4 + LB |
| 117 | RX000005 | RB + MINI-ALLSTOPS3 + PSA2 + SB-ALS PRO::ZM-ALS (HRA) EXON1 + LOXP + ZM-AXIG1 1XOP-B PRO-V1::ZM-WUS2 (CDNA)::IN2-1 TERM-V3 + AT-5-IV-2 INS + ATTB1 + ZM-PLTP PRO::ZM-PLTP 5 UTR::ZM-ODP2 (ALT1)::OS-T28 TERM_PINII TERM + CZ19B1 TERM + ALL STOPS2 + ZM-GLB1 PRO::MO-CRE EXON1::ST-LS1 INTRON2-V2::MO-CRE EXON2 + ATTB2 + PINII TERM-V3 + SB-UBI PRO::SB-UBI INTRON1::ZS-GREEN1::OS-UBI TERM + MINI-ALLSTOPS + LOXP + ZM-ALS (HRA) EXON2::SB-PEPC1 TERM (MOD1) + AT-RPG ELEMENT-V3 + ATTB4 + PV-EGG CELL PRO (TR1):EGG MIN PRO:PV-PRO31696.1 5UTR:: ZM-ODP2 (TR11)_PROTEIN LINKER 1_ZM-ODP2 (TR5)-V2:TAV-T2A (MO1):ZM-CYCD2::PINII TERM + ATTB3 + PSB1 + MINI-ALLSTOPS4 + LB |
| 118 | RX000006 | RB + MINI-ALLSTOPS3 + PSA2 + SB-ALS PRO::ZM-ALS (HRA) EXON1 + LOXP + ZM-AXIG1 1XOP-B PRO-V1::ZM-WUS2 (CDNA)::IN2-1 TERM-V3 + AT-5-IV-2 INS + ATTB1 + ZM-PLTP PRO::ZM-PLTP 5 UTR::ZM-ODP2 (ALT1)::OS-T28 TERM_PINII TERM + CZ19B1 TERM + ALL STOPS2 + ZM-GLB1 PRO::MO-CRE EXON1::ST-LS1 INTRON2-V2::MO-CRE EXON2 + ATTB2 + PINII TERM-V3 + SB-UBI PRO::SB-UBI INTRON1::ZS-GREEN1::OS-UBI TERM + MINI-ALLSTOPS + LOXP + ZM-ALS (HRA) EXON2::SB-PEPC1 TERM (MOD1) + AT-RPG ELEMENT-V3 + ATTB4 + PV-EGG CELL PRO (TR1):EGG MIN PRO:PV-PRO31696.1 5UTR::ZM-ODP2 (TR12)_PROTEIN LINKER 1_ZM-ODP2 (TR5)-V2:TAV-T2A (MO1):ZM-CYCD2::PINII TERM + ATTB3 + PSB1 + MINI-ALLSTOPS4 + LB |

TABLE 2-continued

| SEQ ID NO: | Plasmid | Plasmid Elements |
|---|---|---|
| 137 | RV034409 | RB + LOXP + ATTB4 + PV-EGG CELL PRO (TR1):EGG MIN PRO::PV-PRO31696.1 5UTR:ZM-ODP2:PINII TERM + ATTB1 + ZM-EXP31554.1 PRO-V1::SV40 NLS_CAS9 EXON1 (SP) (MO):ST-LS1 INTRON2:CAS9 EXON2 (SP) (MO):VIRD2 NLS:6FRAME STOPS1::ZM-EGG TERM + ZM-U6 POLIII CHR8 PRO::ZM-NAC7-CR5_GUIDE RNA::ZM-U6 POLIII CHR8 TERM + ZM-U6 POLIII CHR8 PRO::ZM-NAC7-CR5_GUIDE RNA::ZM-U6 POLIII CHR8 TERM + PSN1 + ATTB2 + UBI1ZM PRO::UBI1ZM 5UTR (PHI):UBI1ZM INTRON1 (PHI):DS-RED2 (TR1)::PINII TERM + PV-EGG CELL PRO (TR1):EGG MIN PRO::PV-PRO31696.1 5UTR:MO-CRE EXON1:ST-LS1 INTRON2-V2:MO-CRE EXON2::PINII TERM + UBI1ZM PRO::UBI1ZM 5UTR (PHI):UBI1ZM INTRON1 (PHI):NPTII::PINII TERM + ATTB3 +_LOXP +_LB |
| 138 | RA000007 | RB + LOXP + ATTB4 + PV-EGG CELL PRO (TR1):EGG MIN PRO::PV-PRO31696.1 5UTR:ODP2-(155-669):PINII TERM + ATTB1 + ZM-EXP31554.1 PRO-V1::SV40 NLS_CAS9 EXON1 (SP) (MO):ST-LS1 INTRON2:CAS9 EXON2 (SP) (MO):VIRD2 NLS:6FRAME STOPS1::ZM-EGG TERM + ZM-U6 POLIII CHR8 PRO::ZM-NAC7-CR5_GUIDE RNA:ZM-U6 POLIII CHR8 TERM + ZM-U6 POLIII CHR8 PRO::ZM-NAC7-CR5_GUIDE RNA::ZM-U6 POLIII CHR8 TERM + PSN1 + ATTB2 + UBI1ZM PRO::UBI1ZM 5UTR (PHI):UBI1ZM INTRON1 (PHI):DS-RED2 (TR1)::PINII TERM + PV-EGG CELL PRO (TR1):EGG MIN PRO::PV-PRO31696.1 5UTR:MO-CRE EXON1:ST-LS1 INTRON2-V2:MO-CRE EXON2::PINII TERM + UBI1ZM PRO::UBI1ZM 5UTR (PHI):UBI1ZM INTRON1 (PHI):NPTII::PINII TERM + ATTB3 +_LOXP +_LB |
| 139 | RA000008 | RB + LOXP + ATTB4 + PV-EGG CELL PRO (TR1):EGG MIN PRO::PV-PRO31696.1 5UTR:ODP2-(59-669):PINII TERM + ATTB1 + ZM-EXP31554.1 PRO-V1::SV40 NLS_CAS9 EXON1 (SP) (MO):ST-LS1 INTRON2:CAS9 EXON2 (SP) (MO):VIRD2 NLS:6FRAME STOPS1::ZM-EGG TERM + ZM-U6 POLIII CHR8 PRO::ZM-NAC7-CR5_GUIDE RNA::ZM-U6 POLIII CHR8 TERM + ZM-U6 POLIII CHR8 PRO::ZM-NAC7-CR5_GUIDE RNA::ZM-U6 POLIII CHR8 TERM + PSN1 + ATTB2 + UBI1ZM PRO::UBI1ZM 5UTR (PHI):UBI1ZM INTRON1 (PHI):DS-RED2 (TR1)::PINII TERM + PV-EGG CELL PRO (TR1):EGG MIN PRO::PV-PRO31696.1 5UTR:MO-CRE EXON1:ST-LS1 INTRON2-V2:MO-CRE EXON2::PINII TERM + UBI1ZM PRO::UBI1ZM 5UTR (PHI):UBI1ZM INTRON1 (PHI):NPTII::PINII TERM + ATTB3 +_LOXP +_LB |
| 140 | RA000009 | RB + LOXP + ATTB4 + PV-EGG CELL PRO (TR1):EGG MIN PRO::PV-PRO31696.1 5UTR:ODP2-(231-669):PINII TERM + ATTB1 + ZM-EXP31554.1 PRO-V1::SV40 NLS_CAS9 EXON1 (SP) (MO):ST-LS1 INTRON2:CAS9 EXON2 (SP) (MO):VIRD2 NLS:6FRAME STOPS1::ZM-EGG TERM + ZM-U6 POLIII CHR8 PRO::ZM-NAC7-CR5_GUIDE RNA::ZM-U6 POLIII CHR8 TERM + ZM-U6 POLIII CHR8 PRO::ZM-NAC7-CR5_GUIDE RNA::ZM-U6 POLIII CHR8 TERM + PSN1 + ATTB2 + UBI1ZM PRO::UBI1ZM 5UTR (PHI):UBI1ZM INTRON1 (PHI):DS-RED2 (TR1)::PINII TERM + PV-EGG CELL PRO (TR1):EGG MIN PRO::PV-PRO31696.1 5UTR:MO-CRE EXON1:ST-LS1 INTRON2-V2:MO-CRE EXON2::PINII TERM + UBI1ZM PRO::UBI1ZM 5UTR (PHI):UBI1ZM INTRON1 (PHI):NPTII::PINII TERM + ATTB3 +_LOXP +_LB |
| 141 | RA000010 | RB + LOXP + ATTB4 + PV-EGG CELL PRO (TR1):EGG MIN PRO::PV-PRO31696.1 5UTR:ODP2-(156-171)-(266-669):PINII TERM + ATTB1 + ZM-EXP31554.1 PRO-V1::SV40 NLS_CAS9 EXON1 (SP) (MO):ST-LS1 INTRON2:CAS9 EXON2 (SP) (MO):VIRD2 NLS:6FRAME STOPS1::ZM-EGG TERM + ZM-U6 POLIII CHR8 PRO::ZM-NAC7-CR5_GUIDE RNA::ZM-U6 POLIII CHR8 TERM + ZM-U6 POLIII CHR8 PRO::ZM-NAC7-CR5_GUIDE RNA::ZM-U6 POLIII CHR8 TERM + PSN1 + ATTB2 + UBI1ZM PRO::UBI1ZM 5UTR (PHI):UBI1ZM INTRON1 (PHI):DS-RED2 (TR1)::PINII TERM + PV-EGG CELL PRO (TR1):EGG MIN PRO::PV-PRO31696.1 5UTR:MO-CRE EXON1:ST-LS1 INTRON2-V2:MO-CRE EXON2::PINII TERM + UBI1ZM PRO::UBI1ZM 5UTR (PHI): UBI1ZM INTRON1 (PHI):NPTII::PINII TERM + ATTB3 +_LOXP +_LB |
| 142 | RA000011 | RB + LOXP + ATTB4 + PV-EGG CELL PRO (TR1):EGG MIN PRO::PV-PRO31696.1 5UTR:ODP2-(60-69)-(266-669):PINII TERM + ATTB1 + ZM-EXP31554.1 PRO-V1::SV40 NLS_CAS9 EXON1 (SP) (MO):ST-LS1 INTRON2:CAS9 EXON2 (SP) (MO):VIRD2 NLS:6FRAME STOPS1::ZM-EGG TERM + ZM-U6 POLIII CHR8 PRO::ZM-NAC7-CR5_GUIDE RNA::ZM-U6 POLIII |

TABLE 2-continued

| SEQ ID NO: | Plasmid | Plasmid Elements |
|---|---|---|
| | | CHR8 TERM + ZM-U6 POLIII CHR8 PRO::ZM-NAC7-CR5_GUIDE RNA::ZM-U6 POLIII CHR8 TERM + PSN1 + ATTB2 + UBI1ZM PRO::UBI1ZM 5UTR (PHI):UBI1ZM INTRON1 (PHI):DS-RED2 (TR1)::PINII TERM + PV-EGG CELL PRO (TR1):EGG MIN PRO::PV-PRO31696.1 5UTR:MO-CRE EXON1:ST-LS1 INTRON2-V2:MO-CRE EXON2::PINII TERM + UBI1ZM PRO::UBI1ZM 5UTR (PHI):UBI1ZM INTRON1 (PHI):NPTII::PINII TERM + ATTB3 +_LOXP +_LB |
| 143 | RA000012 | RB + LOXP + ATTB4 + PV-EGG CELL PRO (TR1): EGG MIN PRO::PV-PRO31696.1 5UTR:ODP2-(60-69)-(156-171)-(266-669):PINII TERM + ATTB1 + ZM-EXP31554.1 PRO-V1::SV40 NLS CAS9 EXON1 (SP) (MO):ST-LS1 INTRON2:CAS9 EXON2 (SP) (MO):VIRD2 NLS:6FRAME STOPS1::ZM-EGG TERM + ZM-U6 POLIII CHR8 PRO::ZM-NAC7-CR5_GUIDE RNA::ZM-U6 POLIII CHR8 TERM + ZM-U6 POLIII CHR8 PRO::ZM-NAC7-CR5_GUIDE RNA::ZM-U6 POLIII CHR8 TERM + PSN1 + ATTB2 + UBI1ZM PRO::UBI1ZM 5UTR (PHI):UBI1ZM INTRON1 (PHI):DS-RED2 (TR1)::PINII TERM + PV-EGG CELL PRO (TR1):EGG MIN PRO::PV-PRO31696.1 5UTR:MO-CRE EXON1:ST-LS1 INTRON2-V2:MO-CRE EXON2::PINII TERM + UBI1ZM PRO::UBI1ZM 5UTR (PHI):UBI1ZM INTRON1 (PHI):NPTII::PINII TERM + ATTB3 +_LOXP +_LB |
| 144 | PHP97131 | RB + LOXP + ATTB4 + PV-EGG CELL PRO (TR1):EGG MIN PRO::PV-PRO31696.1 5UTR:ZM-ODP2:PINII TERM + ATTB1 + ZM-EXP31554.1 PRO-V1::SV40 NLS:CAS9 EXON1 (SP) (MO):ST-LS1 INTRON2:CAS9 EXON2 (SP) (MO):VIRD2 NLS:6FRAME STOPS1:ZM-EGG TERM + ZM-U6 POLIII CHR8 PRO::ZM CHR1-53.66-45CR1:GUIDE RNA:ZM-U6 POLIII CHR8 TERM + PSN1 + UBI1ZM PRO::UBI1ZM 5UTR (PHI):UBI1ZM INTRON1 (PHI):DS-RED2 (TR1):PINII TERM + ATTB2 + PV-EGG CELL PRO (TR1):EGG MIN PRO::PV-PRO31696.1 5UTR:MO-CRE EXON1:ST-LS1 INTRON2-V2:MO-CRE EXON2:PINII TERM + ZM CHR1-53.66-45CR1 TARGET SITE:ZM-SEQ158 (GENOMIC):UBI1ZM PRO_UBI1ZM 5UTR (PHI)::UBI1ZM INTRON1 (PHI):FRT1:NPTII::PINII TERM + ZM-SEQ159 (GENOMIC):ZM CHR1-53.66-45CR1 TARGET SITE + ATTB3 + LOXP + MINI-ALLSTOPS + PSB1 + LB |
| 145 | RC000019 | RB + LOXP + ATTB4 + PV-EGG CELL PRO (TR1):EGG MIN PRO::PV-PRO31696.1 5UTR:ZM-ODP2-(155-669):PINII TERM + ATTB1 + ZM-EXP31554.1 PRO-V1::SV40 NLS:CAS9 EXON1 (SP) (MO):ST-LS1 INTRON2:CAS9 EXON2 (SP) (MO):VIRD2 NLS:6FRAME STOPS1:ZM-EGG TERM + ZM-U6 POLIII CHR8 PRO::ZM CHR1-53.66-45CR1:GUIDE RNA:ZM-U6 POLIII CHR8 TERM + PSN1 + UBI1ZM PRO::UBI1ZM 5UTR (PHI):UBI1ZM INTRON1 (PHI):DS-RED2 (TR1):PINII TERM + ATTB2 + PV-EGG CELL PRO (TR1):EGG MIN PRO::PV-PRO31696.1 5UTR:MO-CRE EXON1:ST-LS1 INTRON2-V2:MO-CRE EXON2:PINII TERM + ZM CHR1-53.66-45CR1 TARGET SITE:ZM-SEQ158 (GENOMIC):UBI1ZM PRO_UBI1ZM 5UTR (PHI)::UBI1ZM INTRON1 (PHI):FRT1:NPTII::PINII TERM + ZM-SEQ159 (GENOMIC):ZM CHR1-53.66-45CR1 TARGET SITE + ATTB3 + LOXP + MINI-ALLSTOPS + PSB1 + LB |
| 146 | RC000020 | RB + LOXP + ATTB4 + PV-EGG CELL PRO (TR1):EGG MIN PRO::PV-PRO31696.1 5UTR:ZM-ODP2-(59-669):PINII TERM + ATTB1 + ZM-EXP31554.1 PRO-V1::SV40 NLS:CAS9 EXON1 (SP) (MO):ST-LS1 INTRON2:CAS9 EXON2 (SP) (MO):VIRD2 NLS:6FRAME STOPS1:ZM-EGG TERM + ZM-U6 POLIII CHR8 PRO::ZM CHR1-53.66-45CR1:GUIDE RNA:ZM-U6 POLIII CHR8 TERM + PSN1 + UBI1ZM PRO::UBI1ZM 5UTR (PHI):UBI1ZM INTRON1 (PHI):DS-RED2 (TR1):PINII TERM + ATTB2 + PV-EGG CELL PRO (TR1):EGG MIN PRO::PV-PRO31696.1 5UTR:MO-CRE EXON1:ST-LS1 INTRON2-V2:MO-CRE EXON2:PINII TERM + ZM CHR1-53.66-45CR1 TARGET SITE:ZM-SEQ158 (GENOMIC):UBI1ZM PRO_UBI1ZM 5UTR (PHI)::UBI1ZM INTRON1 (PHI):FRT1:NPTII::PINII TERM + ZM-SEQ159 (GENOMIC):ZM CHR1-53.66-45CR1 TARGET SITE + ATTB3 + LOXP + MINI-ALLSTOPS + PSB1 + LB |
| 147 | RC000021 | RB + LOXP + ATTB4 + PV-EGG CELL PRO (TR1):EGG MIN PRO::PV-PRO31696.1 5UTR:ZM-ODP2-(231-669):PINII TERM + ATTB1 + ZM-EXP31554.1 PRO-V1::SV40 NLS:CAS9 EXON1 (SP) (MO):ST-LS1 INTRON2:CAS9 EXON2 (SP) (MO):VIRD2 NLS:6FRAME STOPS1:ZM-EGG TERM + ZM-U6 POLIII CHR8 PRO::ZM CHR1-53.66-45CR1:GUIDE RNA:ZM-U6 POLIII CHR8 TERM + PSN1 + UBI1ZM PRO::UBI1ZM 5UTR (PHI):UBI1ZM INTRON1 (PHI):DS-RED2 (TR1):PINII TERM + ATTB2 + PV-EGG CELL PRO (TR1): EGG MIN PRO::PV-PRO31696.1 |

TABLE 2-continued

| SEQ ID NO: | Plasmid | Plasmid Elements |
|---|---|---|
| | | 5UTR:MO-CRE EXON1:ST-LS1 INTRON2-V2:MO-CRE EXON2:PINII TERM + ZM CHR1-53.66-45CR1 TARGET SITE:ZM-SEQ158 (GENOMIC):UBI1ZM PRO_UBI1ZM 5UTR (PHI)::UBI1ZM INTRON1 (PHI):FRT1:NPTII::PINII TERM + ZM-SEQ159 (GENOMIC):ZM CHR1-53.66-45CR1 TARGET SITE + ATTB3 + LOXP + MINI-ALLSTOPS + PSB1 + LB |
| 148 | RC000022 | RB + LOXP + ATTB4 + PV-EGG CELL PRO (TR1):EGG MIN PRO::PV-PRO31696.1 5UTR:ZM-ODP2-(156-171)-(266-669):PINII TERM + ATTB1 + ZM-EXP31554.1 PRO-V1::SV40 NLS:CAS9 EXON1 (SP) (MO):ST-LS1 INTRON2:CAS9 EXON2 (SP) (MO):VIRD2 NLS:6FRAME STOPS1:ZM-EGG TERM + ZM-U6 POLIII CHR8 PRO::ZM CHR1-53.66-45CR1:GUIDE RNA:ZM-U6 POLIII CHR8 TERM + PSN1 + UBI1ZM PRO::UBI1ZM 5UTR (PHI):UBI1ZM INTRON1 (PHI):DS-RED2 (TR1):PINII TERM + ATTB2 + PV-EGG CELL PRO (TR1):EGG MIN PRO::PV-PRO31696.1 5UTR:MO-CRE EXON1:ST-LS1 INTRON2-V2:MO-CRE EXON2:PINII TERM + ZM CHR1-53.66-45CR1 TARGET SITE:ZM-SEQ158 (GENOMIC):UBI1ZM PRO_UBI1ZM 5UTR (PHI)::UBI1ZM INTRON1 (PHI):FRT1:NPTII::PINII TERM + ZM-SEQ159 (GENOMIC):ZM CHR1-53.66-45CR1 TARGET SITE + ATTB3 + LOXP + MINI-ALLSTOPS + PSB1 + LB |
| 149 | RC000023 | RB + LOXP + ATTB4 + PV-EGG CELL PRO (TR1):EGG MIN PRO::PV-PRO31696.1 5UTR:ZM-ODP2-(60-69)-(266-669):PINII TERM + ATTB1 + ZM-EXP31554.1 PRO-V1::SV40 NLS:CAS9 EXON1 (SP) (MO):ST-LS1 INTRON2:CAS9 EXON2 (SP) (MO):VIRD2 NLS:6FRAME STOPS1:ZM-EGG TERM + ZM-U6 POLIII CHR8 PRO::ZM CHR1-53.66-45CR1:GUIDE RNA:ZM-U6 POLIII CHR8 TERM + PSN1 + UBI1ZM PRO::UBI1ZM 5UTR (PHI):UBI1ZM INTRON1 (PHI):DS-RED2 (TR1):PINII TERM + ATTB2 + PV-EGG CELL PRO (TR1):EGG MIN PRO::PV-PRO31696.1 5UTR:MO-CRE EXON1:ST-LS1 INTRON2-V2:MO-CRE EXON2:PINII TERM + ZM CHR1-53.66-45CR1 TARGET SITE:ZM-SEQ158 (GENOMIC):UBI1ZM PRO_UBI1ZM 5UTR (PHI)::UBI1ZM INTRON1 (PHI):FRT1:NPTII::PINII TERM + ZM-SEQ159 (GENOMIC):ZM CHR1-53.66-45CR1 TARGET SITE + ATTB3 + LOXP + MINI-ALLSTOPS + PSB1 + LB |
| 150 | RC000024 | RB + LOXP + ATTB4 + PV-EGG CELL PRO (TR1):EGG MIN PRO::PV-PRO31696.1 5UTR:ZM-ODP2-(60-69)-(156-171)-(266-669):PINII TERM + ATTB1 + ZM-EXP31554.1 PRO-V1::SV40 NLS:CAS9 EXON1 (SP) (MO):ST-LS1 INTRON2:CAS9 EXON2 (SP) (MO):VIRD2 NLS:6FRAME STOPS1:ZM-EGG TERM + ZM-U6 POLIII CHR8 PRO::ZM CHR1-53.66-45CR1:GUIDE RNA:ZM-U6 POLIII CHR8 TERM + PSN1 + UBI1ZM PRO::UBI1ZM 5UTR (PHI):UBI1ZM INTRON1 (PHI):DS-RED2 (TR1):PINII TERM + ATTB2 + PV-EGG CELL PRO (TR1):EGG MIN PRO::PV-PRO31696.1 5UTR:MO-CRE EXON1:ST-LS1 INTRON2-V2:MO-CRE EXON2:PINII TERM + ZM CHR 1-53.66-45CR1 TARGET SITE:ZM-SEQ158 (GENOMIC):UBI1ZM PRO_UBI1ZM 5UTR (PHI)::UBI1ZM INTRON1 (PHI):FRT1:NPTII::PINII TERM + ZM-SEQ159 (GENOMIC):ZM CHR1-53.66-45CR1 TARGET SITE + ATTB3 + LOXP + MINI-ALLSTOPS + PSB1 + LB |
| 151 | RV020636 | RB + FMV ENH:PSCV ENH:MMV ENH:ZM-PLTP PRO:3XEME::ZM-WUS2::IN2-1 TERM + NOS PRO::CRC:SB-GKAF TERM (MOD1) + LB |
| 154 | RV03440X | RB + LOXP + ATTB4 + PV-EGG CELL PRO (TR1):EGG MIN PRO::PV-PRO31696.1 5UTR:ZM-ODP2:PINII TERM + ATTB1 + PSN1 + ATTB2 + UBI1ZM PRO::UBI1ZM 5UTR (PHI):UBI1ZM INTRON1 (PHI):DS-RED2 (TR1)::PINII TERM + ZM-EXP31554.1 PRO-V1::MO-CRE EXON1:ST-LS1 INTRON2-V2:MO-CRE EXON2::PINII TERM + UBI1ZM PRO::UBI1ZM 5UTR (PHI):UBI1ZM INTRON1 (PHI):NPTII::PINII TERM + ATTB3 +_LOXP +_LB |
| 155 | RZ000001 | RB + LOXP + ATTB4 + PV-EGG CELL PRO (TR1):EGG MIN PRO::PV-PRO31696.1 5UTR:ZM-ODP2 (TR9):PINII TERM + ATTB1 + PSN1 + ATTB2 + UBI1ZM PRO::UBI1ZM 5UTR (PHI):UBI1ZM INTRON1 (PHI):DS-RED2 (TR1)::PINII TERM + ZM-EXP31554.1 PRO-V1::MO-CRE EXON1:ST-LS1 INTRON2-V2:MO-CRE EXON2::PINII TERM + UBI1ZM PRO::UBI1ZM 5UTR (PHI):UBI1ZM INTRON1 (PHI):NPTII::PINII TERM + ATTB3 + LOXP + LB |
| 156 | RZ000002 | RB + LOXP + ATTB4 + PV-EGG CELL PRO (TR1):EGG MIN PRO::PV-PRO31696.1 5UTR:ZM-ODP2 (TR10):PINII TERM + ATTB1 + PSN1 + ATTB2 + UBI1ZM PRO::UBI1ZM 5UTR (PHI):UBI1ZM INTRON1 (PHI):DS-RED2 (TR1)::PINII TERM + ZM-EXP31554.1 PRO-V1::MO-CRE EXON1:ST-LS1 INTRON2-V2:MO-CRE EXON2::PINII TERM + UBI1ZM PRO::UBI1ZM |

TABLE 2-continued

| SEQ ID NO: | Plasmid | Plasmid Elements |
|---|---|---|
| | | 5UTR (PHI):UBI1ZM INTRON1 (PHI):NPTII::PINII TERM + ATTB3 +_LOXP +_LB |
| 157 | RZ000003 | RB + LOXP + ATTB4 + PV-EGG CELL PRO (TR1):EGG MIN PRO::PV-PRO31696.1 5UTR:ZM-ODP2 (TR8):PINII TERM + ATTB1 + PSN1 + ATTB2 + UBI1ZM PRO::UBI1ZM 5UTR (PHI):UBI1ZM INTRON1 (PHI):DS-RED2 (TR1)::PINII TERM + ZM-EXP31554.1 PRO-V1::MO-CRE EXON1:ST-LS1 INTRON2-V2:MO-CRE EXON2::PINII TERM + UBI1ZM PRO::UBI1ZM 5UTR (PHI):UBI1ZM INTRON1 (PHI):NPTII::PINII TERM + ATTB3 +_LOXP +_LB |
| 158 | RZ000004 | RB + LOXP + ATTB4 + PV-EGG CELL PRO (TR1):EGG MIN PRO::PV-PRO31696.1 5UTR:ZM-ODP2 (TR12)-linker-ZM-ODP2 (TR5)-V2:PINII TERM + ATTB1 + PSN1 + ATTB2 + UBI1ZM PRO::UBI1ZM 5UTR (PHI):UBI1ZM INTRON1 (PHI):DS-RED2 (TR1)::PINII TERM + ZM-EXP31554.1 PRO-V1::MO-CRE EXON1:ST-LS1 INTRON2-V2:MO-CRE EXON2::PINII TERM + UBI1ZM PRO::UBI1ZM 5UTR (PHI):UBI1ZM INTRON1 (PHI):NPTII::PINII TERM + ATTB3 +_LOXP +_LB |
| 159 | RZ000005 | RB + LOXP + ATTB4 + PV-EGG CELL PRO (TR1):EGG MIN PRO::PV-PRO31696.1 5UTR:ZM-ODP2 (TR11)-linker-ZM-ODP2 (TR5)-V2:PINII TERM + ATTB1 + PSN1 + ATTB2 + UBI1ZM PRO::UBI1ZM 5UTR (PHI):UBI1ZM INTRON1 (PHI):DS-RED2 (TR1)::PINII TERM + ZM-EXP31554.1 PRO-V1::MO-CRE EXON1:ST-LS1 INTRON2-V2:MO-CRE EXON2::PINII TERM + UBI1ZM PRO::UBI1ZM 5UTR (PHI):UBI1ZM INTRON1 (PHI):NPTII::PINII TERM + ATTB3 +_LOXP +_LB |
| 160 | RZ000006 | RB + LOXP + ATTB4 + PV-EGG CELL PRO (TR1):EGG MIN PRO::PV-PRO31696.1 5UTR:ZM-ODP2 (TR11)-linker-ZM-ODP2 (TR12)-linker-ZM-ODP2 (TR5):PINII TERM + ATTB1 + PSN1 + ATTB2 + UBI1ZM PRO::UBI1ZM 5UTR (PHI):UBI1ZM INTRON1 (PHI):DS-RED2 (TR1)::PINII TERM + ZM-EXP31554.1 PRO-V1::MO-CRE EXON1:ST-LS1 INTRON2-V2:MO-CRE EXON2::PINII TERM + UBI1ZM PRO::UBI1ZM 5UTR (PHI):UBI1ZM INTRON1 (PHI):NPTII::PINII TERM + ATTB3 +_LOXP +_LB |
| 152 | Dz470 control | RB + PSA2 + ZM-ALS (HRA) EXON1:ST-LS1 INTRON2 FRAG1 + LOXP + ZM-AXIG1 1XOP-B PRO-V1::ZM-WUS2 (CDNA)::INS2-1 TERM + AT-5-IV-2 INS + ATTB1 + ZM-PLTP PRO::ZM-PLTP 5UTR:ZM-ODP2 (ALT1)::OS-T28 TERM:PINII TERM:CS19B1 TERM + ALL STOPS2 + ZM-GLOB1 PRO::MO-CRE EXON1:ST-LS1 INTRON-V2:MO-CRE EXON2 + ATTB2 + PINII TERM-V3 + SU-UBI PRO::SB-UBI INTRO1:ZS-GREEN1::OS-UBI TERM + MINI-ALLSTOPS + LOXP + ST-LS1 INTRO2-V3 FRAG2:ZM-ALS (HRA) EXON2::SB-PEPC1 TERM (MOD1) + ATTB4 + PV-EGG CELL PRO (TR1):PV-PRO31696.1 5UTR:EGG MIN PRO::PINII TERM + ATTB3 + PSB1 + MINI-ALLSTOPSS4 + LB |
| 153 | Dz470 experimental | RB + PSA2 + ZM-ALS (HRA) EXON1:ST-LS1 INTRON2 FRAG1 + LOXP + ZM-AXIG1 1XOP-B PRO-V1::ZM-WUS2 (CDNA)::INS2-1 TERM + AT-5-IV-2 INS + ATTB1 + ZM-PLTP PRO::ZM-PLTP 5UTR:ZM-ODP2 (ALT1)::OS-T28 TERM:PINII TERM:CS19B1 TERM + ALL STOPS2 + ZM-GLOB1 PRO::MO-CRE EXON1:ST-LS1 INTRON-V2:MO-CRE EXON2 + ATTB2 + PINII TERM-V3 + SU-UBI PRO::SB-UBI INTRO1:ZS-GREEN1::OS-UBI TERM + MINI-ALLSTOPS + LOXP + ST-LS1 INTRO2-V3 FRAG2:ZM-ALS (HRA) EXON2::SB-PEPC1 TERM (MOD1) + ATTB4 + PV-EGG CELL PRO (TR1):PV-PRO31696.1 5UTR:EGG MIN PRO::DZ470::PINII TERM + ATTB3 + PSB1 + MINI-ALLSTOPSS4 + LB |
| 498 | RP000001 | RB + SB-ALS PRO:ZM-ALS (HRA) EXON1::ST-LS1 INTRON2 FRAG1 + LOXP + ZM-AXIG1 1XOP-B PRO-V1::ZM-WUS2 (CDNA)::IN2-1 TERM + ZM-PLTP PRO:ZM-PLTP 5 UTR:ZM-ODP2 (ALT1)::OS-T28 TERM:PINII TERM:CZ19B1 TERM + ZM-GLB1 PRO::MO-CRE EXON1:ST-LS1 INTRON2-V2:MO-CRE EXON2::PINII TERM-V3 + SB-UBI PRO::SB-UBI INTRON1:ZS-GREEN1::OS-UBI TERM + LOXP +ST-LS1 INTRON2-V3 FRAG2:ZM-ALS (HRA) EXON2::SB-PEPC1 TERM (MOD1) + ZM-PRF2 PRO::ZM-PRF2 5UTR::PINII TERM + UBI1ZM PRO::UBI1ZM 5UTR (PHI):UBI1ZM INTRON1 (PHI):DS-RED2 (TR1)::PINII TERM + LB |
| 499 | RP000002 | RB + SB-ALS PRO::ZM-ALS (HRA) EXON1::ST-LS1 INTRON2 FRAG1 + LOXP + ZM-AXIG1 1XOP-B PRO-V1::ZM-WUS2 (CDNA)::IN2-1 TERM + ZM-PLTP PRO:ZM-PLTP 5 UTR:ZM-ODP2 (ALT1)::OS-T28 TERM:PINII TERM:CZ19B1 TERM + ZM-GLB1 PRO::MO-CRE EXON1:ST-LS1 INTRON2-V2:MO-CRE EXON2::PINII TERM-V3 + SB-UBI PRO::SB-UBI INTRON1:ZS- |

TABLE 2-continued

| SEQ ID NO: | Plasmid | Plasmid Elements |
|---|---|---|
| | | GREEN1::OS-UBI TERM + LOXP +ST-LS1 INTRON2-V3 FRAG2:ZM-ALS (HRA) EXON2::SB-PEPC1 TERM (MOD1) + ZM-PRF2 PRO::ZM-PRF2 5UTR:dpzm01g012740 CDS::PINII TERM + UBI1ZM PRO::UBI1ZM 5UTR (PHI):UBI1ZM INTRON1 (PHI):DS-RED2 (TR1)::PINII TERM + LB |
| 502 | RV044486 | RB + MINI-ALLSTOPS3 + SB-ALS PRO::ZM-ALS (HRA) EXON1 + LOXP + ZM-AXIG1 1XOP-B PRO-V1::ZM-WUS2 (CDNA)::IN2-1 TERM + AT-5-IV-2 INS + ZM-PLTP PRO::ZM-PLTP 5 UTR::ZM-ODP2 (ALT1)::OS-T28 TERM::PINII TERM::CZ19B1 TERM + ALL STOPS2 + ZM-GLB1 PRO::MO-CRE EXON1::ST-LS1 INTRON2-V2::MO-CRE EXON2::PINII TERM-V3 + SB-UBI PRO::SB-UBI INTRON1::ZS-GREEN1::OS-UBI TERM + MINI-ALLSTOPS + LOXP + ZM-ALS (HRA) EXON2::SB-PEPC1 TERM (MOD1) + AT-RPG ELEMENT-V3 + PV-EGG CELL PRO (TR1): PV-PRO31696.1 5UTR: EGG MIN PRO::ZM-ODP2 (TR11): PROTEIN LINKER 1: ZM-ODP2 (TR12): PROTEIN LINKER 1: ZM-ODP2 (TR5)-V2::PINII TERM + PV-EGG CELL PRO (TR1): PV-PRO31696.1 5UTR: EGG MIN PRO::ZM-ALY2:: PINII TERM + MINI-ALLSTOPS4 + LB |
| 503 | RV044827 | RB + MINI-ALLSTOPS3 + SB-ALS PRO::ZM-ALS (HRA) EXON1 + LOXP + ZM-AXIG1 1XOP-B PRO-V1::ZM-WUS2 (CDNA)::IN2-1 TERM + AT-5-IV-2 INS + ZM-PLTP PRO::ZM-PLTP 5 UTR::ZM-ODP2 (ALT1)::OS-T28 TERM::PINII TERM::CZ19B1 TERM + ALL STOPS2 + ZM-GLB1 PRO::MO-CRE EXON1::ST-LS1 INTRON2-V2::MO-CRE EXON2::PINII TERM-V3 + SB-UBI PRO::SB-UBI INTRON1::ZS-GREEN1::OS-UBI TERM + MINI-ALLSTOPS + LOXP + ZM-ALS (HRA) EXON2::SB-PEPC1 TERM (MOD1) + AT-RPG ELEMENT-V3 + PV-EGG CELL PRO (TR1): PV-PRO31696.1 5UTR: EGG MIN PRO::ZM-ODP2 (TR5)::PINII TERM + PV-EGG CELL PRO (TR1): PV-PRO31696.1 5UTR: EGG MIN PRO::ZM-CGA1::PINII TERM + MINI-ALLSTOPS4 + LB |
| 504 | RV044485 | RB + MINI-ALLSTOPS3 + SB-ALS PRO::ZM-ALS (HRA) EXON1 + LOXP + ZM-AXIG1 1XOP-B PRO-V1::ZM-WUS2 (CDNA)::IN2-1 TERM + AT-5-IV-2 INS + ZM-PLTP PRO::ZM-PLTP 5 UTR::ZM-ODP2 (ALT1)::OS-T28 TERM::PINII TERM::CZ19B1 TERM + ALL STOPS2 + ZM-GLB1 PRO::MO-CRE EXON1::ST-LS1 INTRON2-V2::MO-CRE EXON2::PINII TERM-V3 + SB-UBI PRO::SB-UBI INTRON1::ZS-GREEN1::OS-UBI TERM + MINI-ALLSTOPS + LOXP + ZM-ALS (HRA) EXON2::SB-PEPC1 TERM (MOD1) + AT-RPG ELEMENT-V3 + PV-EGG CELL PRO (TR1): PV-PRO31696.1 5UTR: EGG MIN PRO::ZM-ODP2 (TR11): PROTEIN LINKER 1: ZM-ODP2 (TR12): PROTEIN LINKER 1: ZM-ODP2 (TR5)-V2::PINII TERM + PV-EGG CELL PRO (TR1): PV-PRO31696.1 5UTR: EGG MIN PRO:: ZM-JMJ25::PINII TERM + MINI-ALLSTOPS4 + LB |
| 505 | RV044675 | RB + MINI-ALLSTOPS3 + SB-ALS PRO::ZM-ALS (HRA) EXON1 + LOXP + ZM-AXIG1 1XOP-B PRO-V1::ZM-WUS2 (CDNA)::IN2-1 TERM + AT-5-IV-2 INS + ZM-PLTP PRO::ZM-PLTP 5 UTR::ZM-ODP2 (ALT1)::OS-T28 TERM::PINII TERM::CZ19B1 TERM + ALL STOPS2 + ZM-GLB1 PRO::MO-CRE EXON1::ST-LS1 INTRON2-V2::MO-CRE EXON2::PINII TERM-V3 + SB-UBI PRO::SB-UBI INTRON1::ZS-GREEN1::OS-UBI TERM + MINI-ALLSTOPS + LOXP + ZM-ALS (HRA) EXON2::SB-PEPC1 TERM (MOD1) + AT-RPG ELEMENT-V3 + PV-EGG CELL PRO (TR1): PV-PRO31696.1 5UTR: EGG MIN PRO::ZM-ODP2 (TR11): PROTEIN LINKER 1: ZM-ODP2 (TR12): PROTEIN LINKER 1: ZM-ODP2 (TR5)-V2::PINII TERM + PV-EGG CELL PRO (TR1): PV-PRO31696.1 5UTR: EGG MIN PRO:: ZM-APSR1::PINII TERM + MINI-ALLSTOPS4 + LB |

Example 2: Culture Media

See Table 3 and Table 4 for a description of media formations for transformation, selection and regeneration useful in the methods of the present disclosure.

TABLE 3

| Medium components | Units per liter | 12R | 810K | 700A | 710I |
|---|---|---|---|---|---|
| MS BASAL SALT MIXTURE | g | | | 4.3 | 4.3 |
| N6 BASAL SALTS | g | | | | |
| N6 MACRONUTRIENTS 10X | ml | | | | |
| POTASSIUM NITRATE | g | | | | |
| B5H MINOR SALTS 1000X | ml | | | | |
| NaFe EDTA FOR B5H 100X | ml | | | | |
| ERIKSSON'S VITAMINS 1000X | ml | | | | |
| S&H VITAMIN STOCK 100X | ml | | | | |
| THIAMINE•HCL | mg | | | 10.0 | 10.0 |
| L-PROLINE | g | | | | 0.7 |
| CASEIN HYDROLYSATE (ACID) | g | | | | |
| SUCROSE | g | | | 68.5 | 20.0 |
| GLUCOSE | g | 5.0 | | 36.0 | 10.0 |
| 2,4-D | mg | | | 1.5 | 2.0 |
| AGAR | g | 15.0 | | | 8.0 |
| BACTO-AGAR | g | | 15.0 | | |
| DICAMBA | g | | | | |
| SILVER NITRATE | mg | | | | |
| AGRIBIO Carbenicillin | mg | | | | |
| Timentin | mg | | | | |
| Cefotaxime | mg | | | | |
| MYO-INOSITOL | g | | | 0.1 | 0.1 |
| NICOTINIC ACID | mg | | | 0.5 | 0.5 |
| PYRIDOXINE•HCL | mg | | | 0.5 | 0.5 |
| VITAMIN ASSAY CASAMINO ACIDS | g | | | 1.0 | |
| MES BUFFER | g | | | | 0.5 |
| ACETOSYRINGONE | uM | | | | 100.0 |
| ASCORBIC ACID 10 MG/ML (7S) | mg | | | | 10.0 |
| MS VITAMIN STOCK SOL. | ml | | | | |
| ZEATIN | mg | | | | |
| CUPRIC SULFATE | mg | | | | |
| IAA 0.5 MG/ML (28A) | ml | | | | |
| ABA 0.1 mm | ml | | | | |
| THIDIAZURON | mg | | | | |
| AGRIBIO Carbenicillin | mg | | | | |
| BAP | mg | | | | |
| YEAST EXTRACT (BD Difco) | g | | 5.0 | | |
| PEPTONE | g | | 10.0 | | |
| SODIUM CHLORIDE | g | | 5.0 | | |
| SPECTINOMYCIN | mg | 50.0 | 50.0 | | |
| FERROUS SULFATE•7H20 | ml | 2.0 | | | |
| AB BUFFER 20X (12D) | ml | 50.0 | | | |
| AB SALTS 20X (12E) | ml | 50.0 | | | |
| THYMIDINE | mg | 50.0 | 50.0 | 50.0 | |
| GENTAMYCIN | mg | 50.0 | 50.0 | | |
| MEROPENEM | mg | | | | |
| pH | | | 6.8 | 5.2 | 5.8 |

TABLE 4

| Medium components | Units per liter | 605J | 605B | 562V | 289Q |
|---|---|---|---|---|---|
| MS BASAL SALT MIXTURE | g | 4.3 | 4.3 | | 4.3 |
| N6 BASAL SALTS | g | | | 4.0 | |
| N6 MACRONUTRIENTS 10X | ml | 60.0 | 60.0 | | |
| POTASSIUM NITRATE | g | 1.7 | 1.7 | | |
| B5H MINOR SALTS 1000X | ml | 0.6 | 0.6 | | |
| NaFe EDTA FOR B5H 100X | ml | 6.0 | 6.0 | | |
| ERIKSSON'S VITAMINS 1000X | ml | 0.4 | 0.4 | 1.0 | |
| S&H VITAMIN STOCK 100X | ml | 6.0 | 6.0 | | |
| THIAMINE•HCL | mg | 0.5 | 0.5 | 0.5 | |
| L-PROLINE | g | 2.0 | 2.0 | 0.69 | 0.7 |
| CASEIN HYDROLYSATE (ACID) | g | 0.3 | 0.3 | | |
| SUCROSE | g | 20.0 | 20.0 | 30.0 | 60.0 |
| GLUCOSE | g | 0.6 | 0.6 | | |
| 2,4-D | mg | 0.8 | 0.8 | 2.0 | |
| AGAR | g | 6.0 | 6.0 | 8.0 | 8.0 |
| BACTO-AGAR | g | | | | |
| DICAMBA | g | 1.2 | 1.2 | | |
| SILVER NITRATE | mg | 3.4 | 3.4 | 0.85 | |
| AGRIBIO Carbenicillin | mg | 100.0 | | | |
| Timentin | mg | | | | 150.0 |
| Cefotaxime | mg | | | | 100.0 |
| MYO-INOSITOL | g | | | | 0.1 |
| NICOTINIC ACID | mg | | | | |
| PYRIDOXINE•HCL | mg | | | | |
| VITAMIN ASSAY CASAMINO ACIDS | g | | | | |
| MES BUFFER | g | | | | |
| ACETOSYRINGONE | uM | | | 100.0 | |
| ASCORBIC ACID 10 MG/ML (7S) | mg | | | | |
| MS VITAMIN STOCK SOL. | ml | | | | 5.0 |
| ZEATIN | mg | | | | 0.5 |
| CUPRIC SULFATE | mg | | | | 1.3 |
| IAA 0.5 MG/ML (28A) | ml | | | | 2.0 |
| ABA 0.1 mm | ml | | | | 1.0 |
| THIDIAZURON | mg | | | | 0.1 |
| AGRIBIO Carbenicillin | mg | | | | 100.0 |
| BAP | mg | | | | 1.0 |
| YEAST EXTRACT (BD Difco) | g | | | | |
| PEPTONE | g | | | | |
| SODIUM CHLORIDE | g | | | | |
| SPECTINOMYCIN | mg | | | | |
| FERROUS SULFATE•7H20 | ml | | | | |
| AB BUFFER 20X (12D) | ml | | | | |
| AB SALTS 20X (12E) | ml | | | | |
| THYMIDINE | mg | | | 50.0 | |
| GENTAMYCIN | mg | | | | |
| MEROPENEM | mg | | 10.0 | | |
| pH | | 5.8 | 5.8 | 5.8 | 5.6 |

Example 3: *Agrobacterium*-Mediated Transformation of Corn

A. Preparation of *Agrobacterium* Master Plate

*Agrobacterium tumefaciens* harboring a binary donor vector was streaked out from a −80° C. frozen aliquot onto solid 12R medium and cultured at 28° C. in the dark for 2-3 days to make a master plate.

B. Growing *Agrobacterium* on Solid Medium

A single colony or multiple colonies of *Agrobacterium* were picked from the master plate and streaked onto a second plate containing 810K medium and incubated at 28° C. in the dark overnight. *Agrobacterium* infection medium (700A; 5 ml) and 100 mM 3'-5'-Dimethoxy-4'-hydroxyacetophenone (acetosyringone; 5 L) were added to a 14-mL conical tube in a hood. About 3 full loops of *Agrobacterium* from the second plate were suspended in the tube and the tube was then vortexed to make an even suspension. The suspension (1 ml) was transferred to a spectrophotometer tube and the optical density (550 nm) of the suspension was adjusted to a reading of about 0.35-1.0. The *Agrobacterium* concentration was approximately 0.5 to $2.0\times10^9$ cfu/mL. The final *Agrobacterium* suspension was aliquoted into 2 mL microcentrifuge tubes, each containing about 1 mL of the suspension. The suspensions were then used as soon as possible.

C. Growing *Agrobacterium* on Liquid Medium

Alternatively, *Agrobacterium* is prepared for transformation by growing in liquid medium. One day before infection, a 125-ml flask is prepared with 30 ml of 557A medium (10.5 g/l potassium phosphate dibasic, 4.5 g/l potassium phosphate monobasic anhydrous, 1 g/l ammonium sulfate, 0.5 g/l sodium citrate dehydrate, 10 g/l sucrose, 1 mM magnesium sulfate) and 30 μL spectinomycin (50 mg/mL) and 30 μL acetosyringone (20 mg/mL). A half loopful of *Agrobacterium* from a second plate is suspended into the flasks and placed on an orbital shaker set at 200 rpm and incubated at 28° C. overnight. The *Agrobacterium* culture is centrifuged at 5000 rpm for 10 min. The supernatant is removed and the *Agrobacterium* infection medium (700A) with acetosyringone solution is added. The bacteria is resuspended by vortex and the optical density (550 nm) of the *Agrobacterium* suspension is adjusted to a reading of about 0.35 to 2.0.

D. Maize Transformation

Ears of a maize (*Zea mays* L.) cultivar were surface-sterilized for 15-20 min in 20% (v/v) bleach (5.25% sodium hypochlorite) plus 1 drop of Tween 20 followed by 3 washes in sterile water. Immature embryos (IEs) were isolated from ears and were placed in 2 ml of the *Agrobacterium* infection medium (700A) with acetosyringone solution. The optimal size of the embryos varies based on the inbred, but for transformation with WUS2 and ZM-ODP2 a wide size range of immature embryo sizes was used. The *Agrobacterium* infection medium (810K) was drawn off and 1 ml of the *Agrobacterium* suspension was added to the embryos and the tube was vortexed for 5-10 sec. The microfuge tube was incubated for 5 min in the hood. The suspension of *Agrobacterium* and embryos were poured onto 7101 (or 562V) co-cultivation medium (see Table 3 and Table 4, respectively). Any embryos left in the tube were transferred to the plate using a sterile spatula. The *Agrobacterium* suspension was then drawn off and the embryos placed axis side down on the media. The plate was incubated in the dark at 21° C. for 1-3 days of co-cultivation and embryos were then transferred to resting medium (605B medium) without selection.

Example 4: Methods of Improving Haploid Parthenogenesis

Peptide domains within the region from V59 to D266 (see FIG. 1) of the full-length ZM-ODP2 peptide were evaluated. Two motif domains were identified in this region, herein called "motif A" comprising the ZM-ODP2 (TR12) DNA fragment (SEQ ID NO: 35) encoding the motif A peptide fragment (SEQ ID NO: 36) and "motif B" comprising the ZM-ODP2 (TR11) DNA fragment (SEQ ID NO: 37) encoding the motif B peptide fragment (SEQ ID NO: 38). Relative to the full-length ZM-ODP2 peptide, the motif B peptide fragment starts at A60 and ends at G69 and the motif A peptide fragment starts at 1156 and ends at P171 (see FIG. 1). DNA polynucleotide fragments were created, wherein each fragment encodes a ZM-ODP2 peptide (see Table 5). Certain DNA polynucleotides, SEQ ID NO: 3, 8, 9, and 10, are synthetic DNA sequences comprising fusions of at least two DNA fragments using an artificial linker to encode a synthetic peptide SEQ ID NO: 13, 18, 19, and 20, respectively.

TABLE 5

| DNA Poly-nucleotide | DNA SEQ ID NO: | DNA length (bp) | Peptide Name | PROTEIN SEQ ID NO: | Peptide length (aa) | Sequence Identity to ZM-ODP2 (%) |
|---|---|---|---|---|---|---|
| ZM-ODP2 | 1 | 2133 | ZM-ODP2 | 11 | 710 | 100.0 |
| ZM-ODP2 (TR5) | 2 | 1218 | ZM-ODP2-(266-669) | 12 | 406 | 56.8 |
| ZM-ODP2 (TR6) | 3 | 963 | ZM-ODP2-(1-266)-(669-710) | 13 | 321 | 38.3 |
| ZM-ODP2 (TR4)-V2 | 4 | 1341 | ZM-ODP2-(266-710) | 14 | 447 | 62.8 |
| ZM-ODP2 (TR9) | 5 | 1548 | ZM-ODP2-(155-669) | 15 | 516 | 72.3 |
| ZM-ODP2 (TR10) | 6 | 1836 | ZM-ODP2-(59-669) | 16 | 612 | 85.8 |
| ZM-ODP2 (TR8) | 7 | 1323 | ZM-ODP2-(231-669) | 17 | 441 | 61.8 |
| ZM-ODP2 (TR12)-linker-ZM-ODP2 (TR5)-V2 | 8 | 1305 | ZM-ODP2-(156-171)-(266-669) | 18 | 435 | 59.3 |
| ZM-ODP2 (TR11)-linker-ZM-ODP2 (TR5)-V2 | 9 | 1287 | ZM-ODP2-(60-69)-(266-669) | 19 | 429 | 58.8 |
| ZM-ODP2 (TR11)-linker-ZM-ODP2 (TR12)-linker-ZM-ODP2 (TR5) | 10 | 1377 | ZM-ODP2-(60-69)-(156-171)-(266-669) | 20 | 459 | 60.9 |

Each DNA polynucleotide encoding a ZM-ODP2 peptide was linked to regulatory elements active in a haploid cell or tissue, for example a promoter active during female gamete development. Alternatively, the ZM-ODP2 nucleotide sequence may be under the control of an inducible promoter. Alternatively, the promoter used is both inducible and tissue-preferred. For example, the promoter is both haploid-tissue specific and inducible. Specifically each DNA polynucleotide encoding a ZM-ODP2 peptide was operably linked to regulatory elements comprising PV-EGG CELL PRO (TR1) (SEQ ID NO: 31), EGG MIN PRO (SEQ ID NO: 32), and PV-PRO31696.1 5UTR (SEQ ID NO: 33), this combination of regulatory elements SEQ ID NO: 31, SEQ ID NO: 32, and SEQ ID NO: 33 is called the "PvEC1 promoter" (SEQ ID NO: 34).

Each respective DNA polynucleotide encoding a ZM-ODP2 peptide was used to create a plasmid containing an expression cassette (see FIG. 1), as shown in Table 6. Accordingly, a series of plasmids were made having expression cassettes comprising these DNA sequences fused with ZM-ODP2 (TR5) (SEQ ID NO: 2) to examine the impact of these domains on haploid parthenogenesis. For example, plasmid RV036694 (SEQ ID NO: 28) comprises the ZM-ODP2 variant 6 expression cassette containing the ZM-ODP2 (TR12)-linker-ZM-ODP2 (TR5)-V2 polynucleotide encoding the ZM-ODP2-(156-171)-(266-669) peptide; plasmid RV036693 (SEQ ID NO: 29) comprises the ZM-ODP2 variant 7 expression cassette containing the ZM-ODP2 (TR11)-linker-ZM-ODP2 (TR5)-V2 encoding the ZM-ODP2-(60-69)-(266-669) peptide; and plasmid RV036695 (SEQ ID NO: 30) comprises the ZM-ODP2 variant 8 expression cassette containing the ZM-ODP2 (TR11)-linker-ZM-ODP2 (TR12)-linker-ZM-ODP2 (TR5) polynucleotide encoding the ZM-ODP2-(60-69)-(156-171)-(266-669) peptide (see Table 6 and FIG. 1).

TABLE 6

| Plasmid | DNA SEQ ID NO: | Expression Cassette | DNA Polynucleotide Name | Peptide Name |
|---|---|---|---|---|
| PHP94831 | 21 | positive control | ZM-ODP2 | ZM-ODP2 |
| PHP92900 | 22 | minimal positive control | ZM-ODP2 (TR5) | ZM-ODP2-(266-669) |
| RV036687 | 23 | ZM-ODP2 variant 1 | ZM-ODP2 (TR6) | ZM-ODP2-(1-266)-(669-710) |
| RV036691 | 24 | ZM-ODP2 variant 2 | ZM-ODP2 (TR4)-V2 | ZM-ODP2-(266-710) |
| RV036689 | 25 | ZM-ODP2 variant 3 | ZM-ODP2 (TR9) | ZM-ODP2-(155-669) |
| RV036690 | 26 | ZM-ODP2 variant 4 | ZM-ODP2 (TR10) | ZM-ODP2-(59-669) |
| RV036688 | 27 | ZM-ODP2 variant 5 | ZM-ODP2 (TR8) | ZM-ODP2-(231-669) |
| RV036694 | 28 | ZM-ODP2 variant 6 | ZM-ODP2 (TR12)-linker-ZM-ODP2 (TR5)-V2 | ZM-ODP2-(156-171)-(266-669) |
| RV036693 | 29 | ZM-ODP2 variant 7 | ZM-ODP2 (TR11)-linker-ZM-ODP2 (TR5)-V2 | ZM-ODP2-(60-69)-(266-669) |
| RV036695 | 30 | ZM-ODP2 variant 8 | ZM-ODP2 (TR11)-linker-ZM-ODP2 (TR12)-linker-ZM-ODP2 (TR5) | ZM-ODP2-(60-69)-(156-171)-(266-669) |

The methods described below use a transformed line containing a parthenogenesis factor, such as ODP2. Preferentially, the transformed line comprises a hybrid genome. During female gametogenesis, expression of the parthenogenesis factor occurs and activity of the parthenogenesis factor is provided in or near the embryo sac cell, particularly the egg cell, to stimulate haploid parthenogenesis. Such haploid parthenogenesis occurs in the absence of egg cell fertilization (see FIG. 2). The maternal central cell requires single fertilization by a sperm cell nucleus from a pollen cell for proper endosperm formation (e.g., pseudogamy, or pseudogamous endosperm). Improved productivity creating maize doubled haploids using maternal (gynogenic) doubled haploid production methods via pseudogamy is demonstrated below.

A. Maternal Haploid Induction in Response to ZM-ODP2 Peptide Variants Using a First Breeding Cross Methods of the present disclosure relate to creating haploid inducer lines by transforming a non-haploid inducing line with a parthenogenesis factor, including but not limited to ODP2. The parthenogenesis factor induces the development and growth of maternal haploid embryos without fertilization by sperm.

Figure 3A:
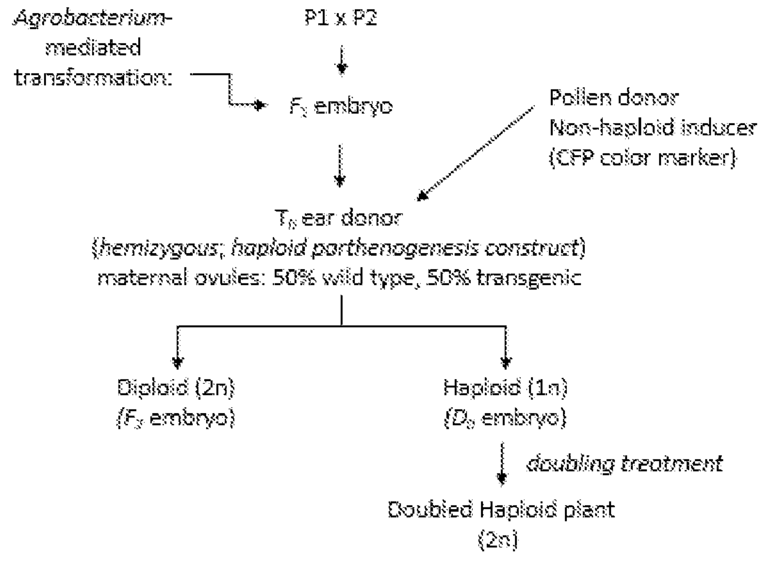
FIG. 3A shows a schematic of the *Agrobacterium*-mediated transformation of an $F_1$ immature embryo obtained from a first biparental cross of Parent 1 ($P_1$) and Parent 2 ($P_2$), wherein the $F_1$ embryo transformed with a parthenogenesis factor (PF) is grown into a mature plant and used as a $T_0$ ear donor. The expected segregation ratio for inheritance of a haploid parthenogenesis construct within the female gametes of each hemizygous $T_0$ plant is 50% wild type female gametes and 50% transgenic female gametes that contain the haploid parthenogenesis construct. The $T_0$ ear donor is fertilized with pollen from a pollen donor, such as a non-haploid inducer plant having a morphological marker, for example a CFP color marker. Haploid embryos lack the morphological marker and are readily separated from diploid embryos.

Specifically, the plasmids shown in Table 6 having the T-DNA features described in Table 2 were used for *Agrobacterium*-mediated transformation of immature diploid embryos. Using the transformation, regeneration, growth, and crossing methods described herein, hemizygous $T_0$ transgenic plants were examined to measure haploid induction levels. In particular, immature $F_1$ hybrid embryos were obtained by performing a first breeding cross. This breeding cross used two different inbred lines ($P_1$ and $P_2$) as the respective parental lines, wherein one parental line used as a female ear donor ($P_1$) was fertilized with pollen obtained from the second, male parental line ($P_2$) (see FIG. 3A). The ears of the female parent plants ($P_1$) were shoot-bagged before silk emergence to avoid any foreign pollen contamination. At approximately 9-14 days after pollination with pollen from the male parental line (P2), the immature ears were harvested. The ears were surface sterilized in 30% bleach plus 0.5% detergent for 20 minutes and rinsed two times with sterile water and the diploid ($F_1$) embryos were transformed with the plasmids shown in Table 6 using the methods described in Example 3.

Post transformation, each regenerated plant that was a hemizygous $T_0$ plant having a stable insert of one copy of a T-DNA was considered a unique event and was grown to maturity. The ears of each hemizygous $T_0$ plant were shoot-bagged before silk emergence to avoid any foreign pollen contamination. The silks of the ears on the plants of the female parent plants were pollinated with viable pollen grains collected from the anthers of a male non-haploid inducer parent plant constitutively expressing a cyan fluorescent protein color marker (CFP). At approximately 9-14 days after pollination, the immature ears were harvested. The ears were surface sterilized in 30% bleach plus 0.5% detergent for 20 minutes and rinsed two times with sterile water.

Embryos were isolated and examined for the presence/absence of CFP expression to detect diploid and haploid embryos, respectively. The percent (%) of CFP negative embryos (haploid embryos) were scored per unique event using the number of haploid embryos divided by the total number of embryos isolated. Ears with poor fertilization (e.g., having less than a total of 50 kernels) were discarded. The mean haploid induction levels and standard deviations (see Table 7) were computed using the average CFP negative embryos (haploid embryos) for all examined events per plasmid.

In this first breeding cross, pairwise comparisons were made for each experimental plasmid shown in Table 6 relative to the positive controls. PHP94831 comprising the full-length ZM-ODP2 peptide (ZM-ODP2) was used as a positive control and PHP92900 comprising a truncated ZM-ODP2 peptide (ZM-ODP2 (TR5)) was used as a minimal positive control. In each pairwise comparison, an experimental plasmid comprising a ZM-ODP2 variant peptide was compared to PHP94831 or PHP92900 using a two-sided Student's t-test ($\alpha$=0.95). The null hypothesis for this test was that a ZM-ODP2 variant peptide will exhibit equal haploid induction levels in comparison to the control plasmid (no difference, nd); the alternative hypothesis for this test was that a ZM-ODP2 variant peptide will not exhibit equal haploid induction levels in comparison to the control plasmid. The results for each pairwise comparison made using this first breeding cross are shown in Table 7.

TABLE 7

| Plasmid | Number of events | Mean (% HI) | SD (% HI) | PHP94831 p value | PHP94831 result | PHP92900 p value | PHP92900 result |
|---|---|---|---|---|---|---|---|
| PHP94831 | 13 | 16.8 | 7.1 | — | — | 3E−05 | p < .01 |
| PHP92900 | 9 | 3.4 | 2.5 | 3E−05 | p < .01 | — | — |
| RV036694 | 15 | 15.5 | 9.1 | .69 | nd | 8E−04 | p < .01 |
| RV036693 | 13 | 16.1 | 7.9 | .827063 | nd | 2E−04 | p < .01 |
| RV036695 | 14 | 31.9 | 10.8 | 2E−04 | p < .01 | <.00001 | p < .01 |
| RV036687 | 15 | 0.0 | 0.1 | <.00001 | p < .01 | 3E−05 | p < .01 |
| RV036688 | 15 | 18.1 | 4.6 | .548 | nd | <.00001 | p < .01 |
| RV036689 | 13 | 23.4 | 8.8 | .046 | p < .05 | <.00001 | p < .01 |
| RV036690 | 8 | 41.0 | 7.1 | <.00001 | p < .01 | <.0000 | p < .01 |
| RV036691 | 6 | 13.0 | 8.0 | .313 | nd | .005 | p < .01 |

Each plasmid containing a ZM-ODP2 variant expression cassette had a mean haploid induction (HI) level that was significantly different at the 95% confidence level than the mean HI level observed using plasmid PHP92900 (minimal positive control). With the exception of plasmid RV036687, in which the ZM-ODP2 variant lacks the two DNA binding domains (DBD) characteristic of AP2 transcription factors (see FIG. 1), each ZM-ODP2 variant peptide altered parthenogenesis and ultimately improved maternal haploid induction relative to PHP92900.

It was then determined if the Table 6 plasmids, containing the ZM-ODP2 variant peptides, were able to improve maternal haploid induction in comparison to PHP94831 (positive control), in which the ZM-ODP2 variant comprises the full-length ZM-ODP2 peptide. As described above in comparison to plasmid PHP92900, plasmid RV036687 was also significantly lower in an ability to induce parthenogenesis and maternal haploid induction ($p<0.00001$, 95% confidence level), as was the haploid induction level observed using the plasmid PHP92900 ($p<0.000026$, 95% confidence level) when compared to PHP94831 (see Table 7).

Unexpectedly, several ZM-ODP2 variant peptides were able to improve haploid induction relative to the full-length ZM-ODP2 peptide. Significantly increased haploid induction levels were observed in response to transformation with plasmids RV036689 (containing a polynucleotide encoding a N-terminus peptide starting at G155 of the full-length ZM-ODP2 peptide) and RV036690 (containing a polynucleotide encoding a N-terminus peptide starting at V59 of the full-length ZM-ODP2 peptide) (see Table 6, Table 7, FIG. 1, and FIG. 3B). These results suggest the region from G155 to D266 and the region from V59 to D266 of the full-length ZM-ODP2 peptide positively affected haploid parthenogenesis.

Figure 3B:
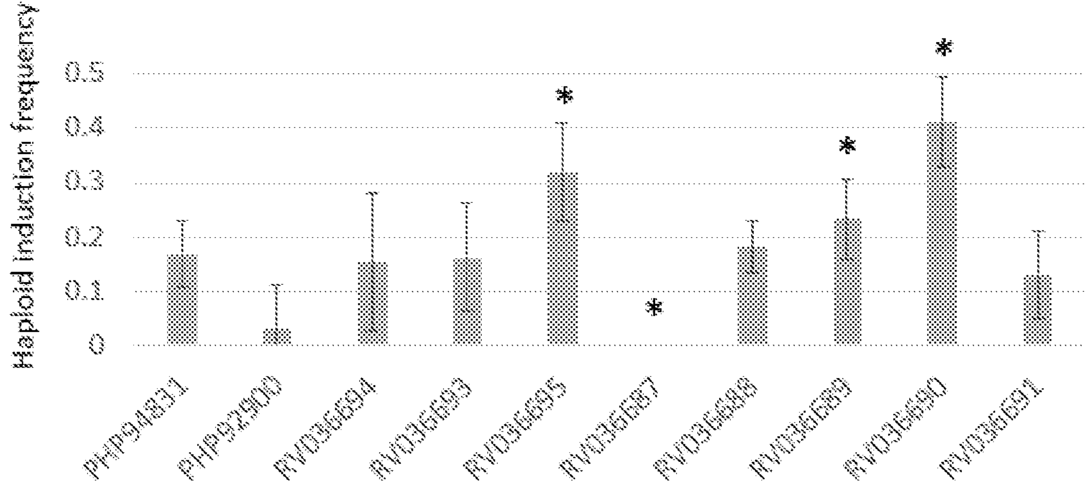
FIG. 3B shows the maternal haploid induction rate in response to egg cell expression of the ODP2 variants shown in FIG. 1 encoded by plasmids PHP94831, PHP92900, RV036694, RV036693, RV036695, RV036687, RV036688, RV036689, RV036690, and RV036691, respectively. The mean haploid induction frequency (y axis) and observed standard deviation (error bars) for each ODP2 variant encoded by each plasmid (x axis) are shown. Mean haploid induction levels significantly different from the mean haploid induction level observed with plasmid PHP94831 encoding the native ZM-ODP2 peptide (asterisk; $p<0.05$ for two-sided Student's t-test ($\alpha=0.05$)) are shown.

In comparison to plasmid PHP92900, wherein the truncated ZM-ODP2-(266-669) peptide exhibited a 3.4% haploid induction level, plasmids RV036693, RV036694, and RV036695 were each significantly different at the 95% confidence level (see Table 7 and FIG. 3B). These results clearly establish a functional role of these domains in confer parthenogenic maternal haploid induction.

In comparison to plasmid PHP94831, wherein the full length ZM-ODP2-(1-710) peptide exhibited a 16.8% haploid induction level, plasmids RV036693 and RV036694 were not significantly different at the 95% confidence level (see Table 7 and FIG. 3B).

Unexpectedly, the mean haploid induction level observed using plasmid RV036695 was significantly different at the 95% confidence level and exhibited an improved level of maternal haploid induction using the ZM-ODP2-(60-69)-(156-171)-(266-669) peptide (see Table 7 and FIG. 3B). This result further demonstrated the functional role these domains confer to improve haploid parthenogenesis.

Furthermore, these results indicated it is possible to design synthetic ZM-ODP2 variants comprising a peptide with at least one N-terminal domain fused to the minimal ZM-ODP2 peptide that further improved parthenogenesis. Specifically, plasmid RV036690 exhibited a significant difference in parthenogenesis induction in comparison to the full-length ZM-ODP2 peptide (see Table 7).

Figures 4A, 4B:
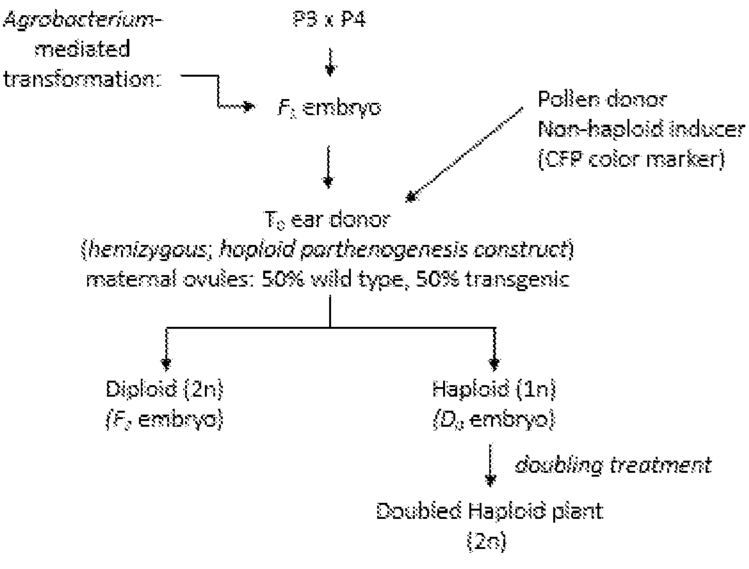
FIG. 4A shows a schematic of the *Agrobacterium*-mediated transformation of an $F_1$ immature embryo obtained from a first biparental cross of Parent 3 ($P_3$) and Parent 4 ($P_4$), wherein the $F_1$ embryo transformed with a parthenogenesis factor is grown into a mature plant and used as a $T_0$ ear donor. The expected segregation ratio for inheritance of a haploid parthenogenesis construct within the female gametes of each hemizygous $T_0$ plant is 50% wild type female gametes and 50% transgenic female gametes that contain the haploid parthenogenesis construct. The $T_0$ ear donor is fertilized with pollen from a pollen donor, such as a non-haploid inducer plant having a morphological marker, for example a CFP color marker. Haploid embryos lack the morphological marker and are readily separated from diploid embryos.
FIG. 4B shows the maternal haploid induction rate in response to egg cell expression of the ODP2 variants shown in FIG. 1 encoded by plasmids PHP94831, PHP92900, RV036694, RV036693, RV036695, RV036687, RV036688, RV036689, RV036690, and RV036691, respectively. The mean haploid induction frequency (y axis) and observed standard deviation (error bars) for each ODP2 variant encoded by each plasmid (x axis) are shown. Mean haploid induction levels significantly different from the mean haploid induction level observed with plasmid PHP94831 encoding the native ZM-ODP2 peptide (asterisk; $p<0.05$ for two-sided Student's t-test ($\alpha=0.05$)) are shown.
Figure 5:
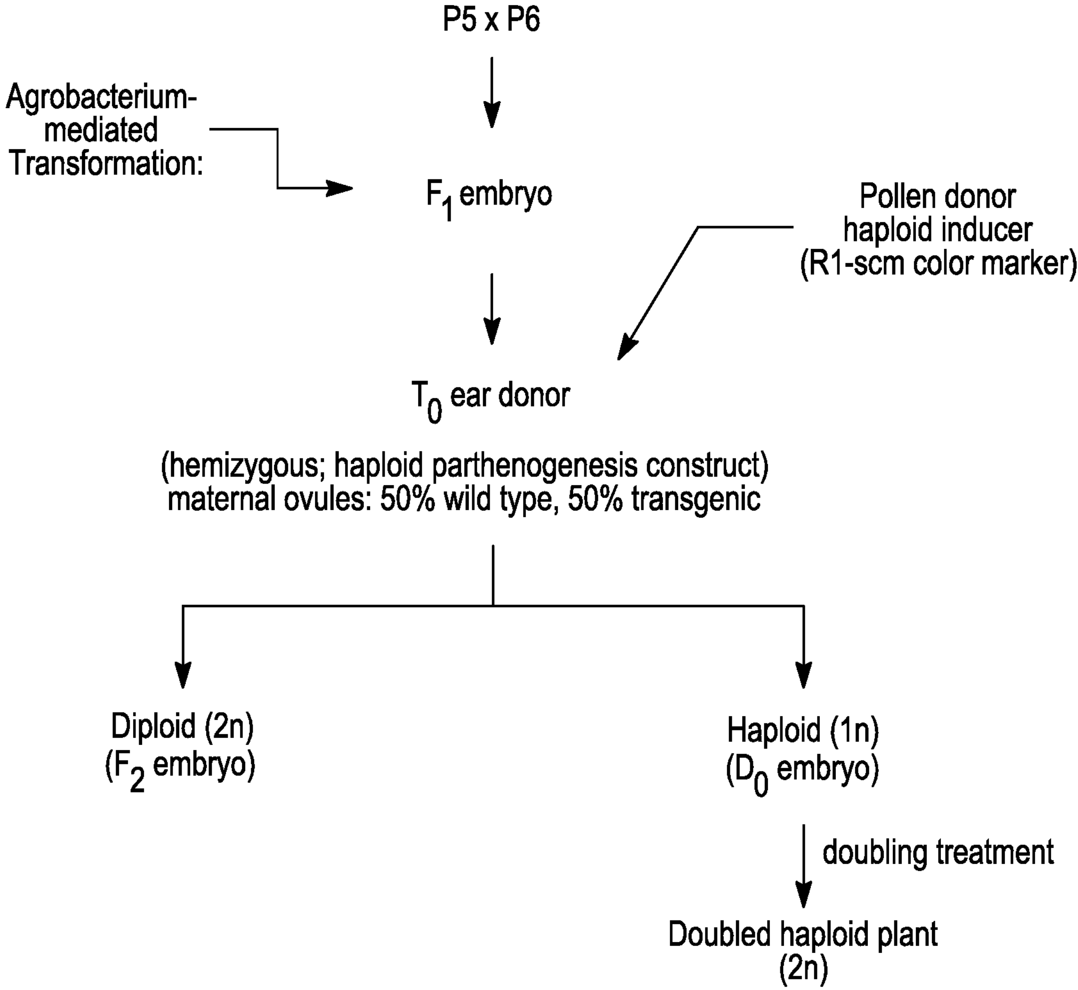
FIG. 5 shows a schematic of the *Agrobacterium*-mediated transformation of an $F_1$ immature embryo obtained from a first biparental cross of Parent 5 ($P_5$) and Parent 6 ($P_6$), wherein the $F_1$ embryo transformed with a parthenogenesis factor is grown into a mature plant and used as a $T_0$ ear donor. The expected segregation ratio for inheritance of a haploid parthenogenesis construct within the female gametes of each hemizygous $T_0$ plant is 50% wild type female gametes and 50% transgenic female gametes that contain the haploid parthenogenesis construct. The $T_0$ ear donor is fertilized with pollen from a pollen donor, such as a haploid inducer plant having a morphological marker, for example a R1-scm allele. Haploid embryos lack the morphological marker and are readily separated from diploid embryos.
Figure 6:
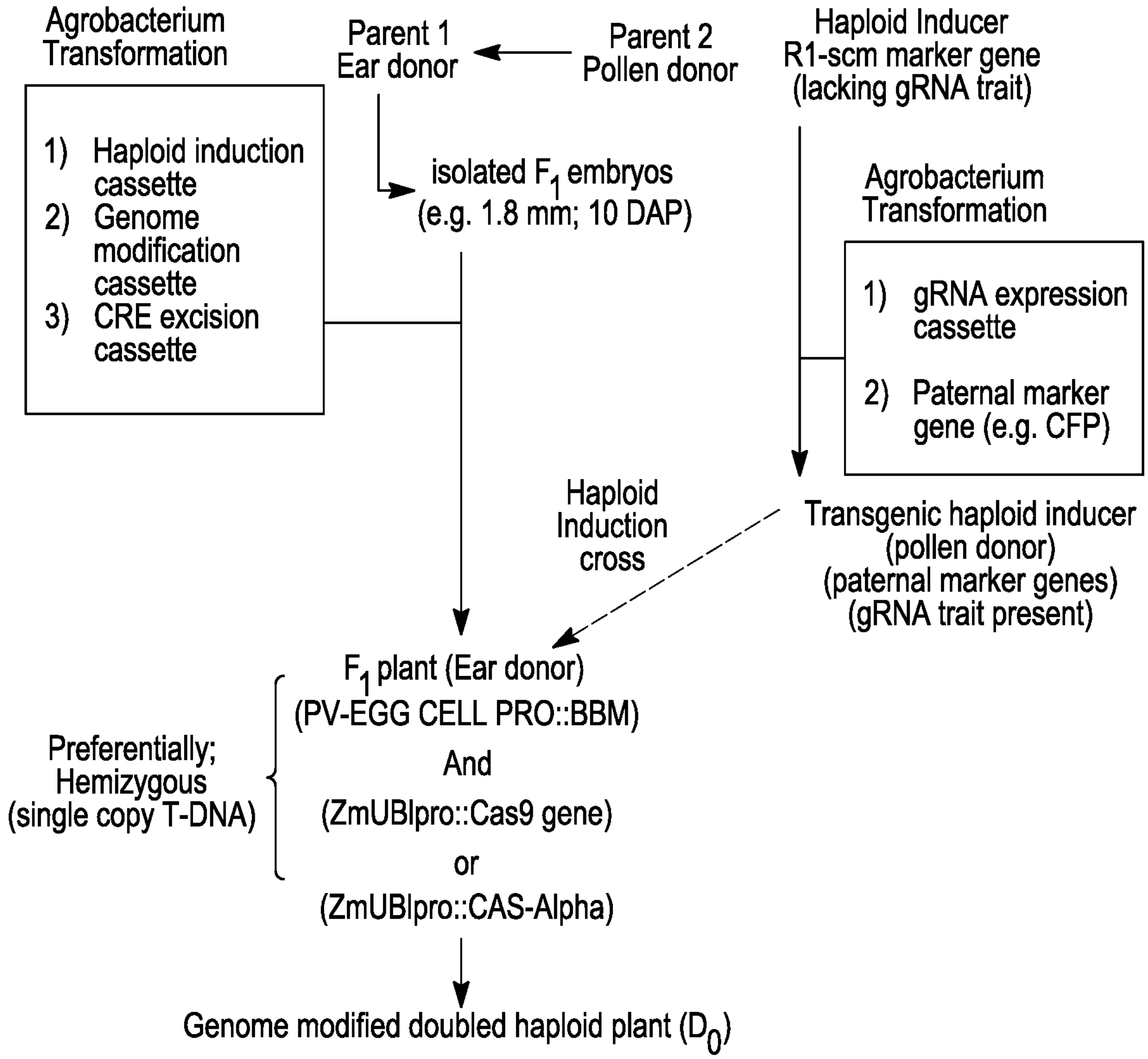
FIG. 6 shows a schematic of methods useful for genome modification and maternal haploid induction. A transgenic plant transformed with a construct conferring parthenogenic haploid induction and genome modification activities that is lacking in a capability to provide a guide RNA to a maternal cell is used as the ear donor that is fertilized with pollen obtained from a transgenic haploid inducer line capable of providing at least one gRNA molecule. The ear donor is a plant derived from a transformed plant cell, for example a plant cell comprising a first filial ($F_1$) hybrid genome that is useful for breeding purposes. The transformed plant has a construct containing a polynucleotide encoding, i) a parthenogenic morphogenetic gene, such as BBM, operably linked to an egg cells promoter, such as the egg cell PV-EGG CELL PRO (TR1) promoter, resulting in a PV-EGG CELL PRO::BBM expression, ii) a nuclease gene, such as a Cas9 or Cas-alpha nuclease, operably linked to an promoter, such as the *Zea mays* Ubiquitin promoter (ZmUBI), resulting in the ZmUBIpro::Cas 9 or ZmUBIpro::Cas-alpha expression cassette, respectively, and iii) a recombinase gene, such as a Cre recombinase, operably linked to an embryogenesis promoter. The pollen donor is a transgenic plant derived from transforming a plant cell from a haploid inducer line. For example, a haploid inducer line that is an inducer such as Stock 6, or any derivative thereof, or a plant cell having a loss-of-function of a patatin-like phospholipase A2 gene. The pollen donor plant has a construct containing a polynucleotide encoding i) at least one gRNA molecule, and ii) a paternal marker gene. This figure also shows the activity of fertilizing the ear donor with pollen of the transgenic haploid inducer line (labelled as "haploid induction cross", dashed arrow), wherein the gRNA of the pollen donor is provided to a maternal cell, thereby enabling the capability to obtain a genome modified doubled haploid plant derived from a genome modified maternal gametophyte.

B. Maternal Haploid Induction in Response to ZM-ODP2 Peptide Variants Using a Second Breeding Cross Given the results shown in A above, induction levels in response to the ZM-ODP2 peptide variants using a second breeding cross were evaluated to determine if similar maternal haploid induction levels in response to the same plasmid activities occurred in a genotype-independent manner. This second breeding cross used a third parental line as a female ear donor (P3) that was fertilized with pollen obtained from a fourth, male parental line (P4) (see FIG. 4A and FIG. 4B). This experiment was conducted in the same manner as described in A above.

In this second breeding cross, pairwise comparisons were made for each experimental plasmid shown in Table 6 relative to the positive controls. PHP94831 comprising the full-length ZM-ODP2 peptide (ZM-ODP2) was used as a positive control and PHP92900 comprising a truncated ZM-ODP2 peptide (ZM-ODP2 (TR5)) was used as a minimal positive control. In each pairwise comparison, an experimental plasmid comprising a ZM-ODP2 variant peptide was compared to PHP94831 or PHP92900 using a two-sided Student's t-test ($\alpha$=0.95). The null hypothesis for this test was that a ZM-ODP2 variant peptide will exhibit equal haploid induction levels in comparison to the control plasmid (no difference, nd); the alternative hypothesis for this test was that a ZM-ODP2 variant peptide will not exhibit equal haploid induction levels in comparison to the control plasmid. The results for each pairwise comparison made using this first breeding cross are shown in Table 8.

TABLE 8

| Plasmid | Number of events | Mean (% HI) | SD (% HI) | PHP94831 p value | PHP94831 result | PHP92900 p value | PHP92900 result |
|---|---|---|---|---|---|---|---|
| PHP94831 | 11 | 0.29 | 0.06 | — | — | .000086 | p < .01 |
| PHP92900 | 12 | 0.14 | 0.08 | .000086 | p < .01 | — | — |
| RV036694 | 9 | 0.33 | 0.13 | .349868 | nd | 6E−04 | p < .01 |
| RV036693 | 16 | 0.31 | 0.10 | .58031 | nd | 8E−05 | p < .01 |
| RV036695 | 11 | 0.34 | 0.09 | .137318 | nd | 2E−05 | p < .01 |
| RV036687 | 13 | 0.00 | 0.00 | <.00001 | p < .01 | <.00001 | p < .01 |
| RV036688 | 5 | 0.37 | 0.05 | .022960 | p < .05 | 3E−05 | p < .01 |
| RV036689 | 10 | 0.35 | 0.07 | .035662 | p < .05 | <.00001 | p < .01 |
| RV036690 | 4 | 0.25 | 0.08 | .366140 | nd | 0.037 | p < .01 |
| RV036691 | 13 | 0.29 | 0.08 | .868179 | nd | 1E−04 | p < .01 |

Each plasmid containing a ZM-ODP2 variant expression cassette had a mean haploid induction (HI) level that was significantly different at the 95% confidence level than the mean HI level observed using plasmid PHP92900 (minimal positive control). With the exception of plasmid RV036687, in which the ZM-ODP2 variant lacks the two DNA binding domains (DBD) characteristic of AP2 transcription factors (see FIG. 1), each ZM-ODP2 variant peptide altered parthenogenesis and ultimately improved maternal haploid induction relative to PHP92900 (see Table 8 and FIG. 4B).

It was then determined if the Table 6 plasmids, containing the ZM-ODP2 variant peptides, were able to improve maternal haploid induction in comparison to PHP94831 (positive control), in which the ZM-ODP2 variant comprises the full-length ZM-ODP2 peptide. As described above in comparison to plasmid PHP92900, plasmid RV036687 was also significantly lower in an ability to induce parthenogenesis and maternal haploid induction (p<0.00001, 95% confidence level), as was the haploid induction level observed using the plasmid PHP92900 (p<0.000086, 95% confidence level) when compared to PHP94831 (see Table 8).

Each of the remaining plasmids encoding an ZM-ODP2 variant peptide exhibited a maternal haploid induction level like that of the full-length ZM-ODP2 peptide provided by plasmid PHP94831 with the following exceptions. First, plasmid RV036688 had a significantly increased mean haploid induction level in comparison to PHP94831 (p<0.022960; see Table 8 and FIG. 4B). Second, plasmid RV036689 also had a significantly increased mean haploid induction in comparison to PHP94831 (p<0.035662; see Table 8 and FIG. 4B). Notably, plasmid RV036689 comprises the motif A domain, thus supporting the results observed in section A above.

The remaining plasmids, RV036690, RV036693, RV036694, and RV036695, were not statistically different from the full-length ZM-ODP2 peptide when transformed into the $F_1$ embryos resulting from this second breeding cross. Nonetheless, the trend for maternal haploid induction like the full-length ZM-ODP2 peptide was observed when using these ZM-ODP2 peptide variants. For example, plasmids RV036693 and RV036694, having motif B (10 amino acids) and motif A (16 amino acids), respectively, translationally fused to ZM-ODP2-(266-669) demonstrated that these motifs complemented ZM-ODP2-(266-669) to have activity like that of the full-length ZM-ODP2 peptide. Interestingly, a 5-percentage point difference (17.2% increase) was observed using plasmid RV036695 (34% mean haploid induction) in comparison to plasmid PHP94831 (29% mean haploid induction); a trend consistent with the results of the first breeding cross. Such a difference is biologically relevant and positively impacts plant breeding processes dependent on such a maternal haploid induction process. Thus, the trend for these results show that ZM-ODP2 variant peptides improved haploid parthenogenesis in maize.

Partial ZM-ODP2 peptides and/or non-naturally occurring ZM-ODP2 fusions comprising a synthetic peptide significantly improved haploid parthenogenesis in comparison to the native ZM-ODP2 peptide as shown in Tables 7 and 8.

C. Maternal Haploid Induction in Response to ZM-ODP2 Peptide Variants Using a Haploid Induction Cross Given the results above shown in section A and B, maternal haploid induction levels in response to haploid parthenogenesis conferred by providing to an egg cell the activity of a ZM-ODP2 variant peptide and in response to fertilization using a maize haploid inducer line (see FIG. 4) are evaluated.

Immature $F_1$ hybrid embryos are obtained by performing a breeding cross, wherein a female parental line ear donor is fertilized with pollen obtained from a male parental line. The ears of the female parent plants are shoot-bagged before silk emergence to avoid any foreign pollen contamination. At approximately 9-14 days after pollination, the immature ears are harvested. The ears are surface sterilized in 30% bleach plus 0.5% Micro detergent for 20 minutes and rinsed two times with sterile water and the diploid embryos are transformed using the methods described in Example 3. Specifically, diploid embryos are transformed using a plasmid having a DNA polynucleotide encoding a ZM-ODP2 variant peptide as shown in Table 4. Plasmids encoding a ZM-ODP2 variant peptide that conferred improved haploid parthenogenesis in comparison to plasmid PHP94831 (SEQ ID NO: 21), as shown in sections A and B of this Example 4, including, but not limited to plasmids RV036689, RV036690, RV036688, RV036694, RV036693, and RV036695 (SEQ ID NO: 25-30, respectively) are useful in the methods disclosed herein.

Each regenerated $F_1$ hybrid plant that is a hemizygous $T_0$ plant having one copy of a stably inserted, single copy T-DNA is considered a unique event and is grown to maturity. The ears of each hemizygous $T_0$ plant are shoot-bagged before silk emergence to avoid any foreign pollen contamination. A haploid induction cross is performed wherein the silks of the ears of the female parent plants are pollinated with viable pollen grains collected from the anthers of a male pollen donor that is a haploid inducer line.

The male pollen donor haploid inducer line is selected from and/or derived from Stock 6, RWK, RWS, UH400, AX5707RS, and NP2222-matl, or any haploid inducer lines. The use of a haploid inducer may comprise a haploid detection method, wherein the haploid inducer line has a morphological marker. The morphological marker identifies diploid and haploid embryos, wherein haploid embryos lacking inheritance of the morphological marker are selected. Methods using morphological markers include detection at an early developmental stage of a fluorescent reporter expression construct, such as a green, yellow, or red fluorescent reporter gene and/or an allele of the anthocyanin genes, such as the R1-scm allele which is expressed in embryos at the early developmental stage. Such marker genes allow the identification of diploid and haploid embryos based on the presence or absence of these reporter gene products, respectively.

After performing the haploid induction cross, immature ears are harvested at approximately 9-14 days after pollination. The ears are surface sterilized in 30% bleach plus 0.5% Micro detergent for 20 minutes and rinsed two times with sterile water. Embryos are isolated and examined for the presence/absence of the paternally inherited morphological marker to count diploid and haploid embryos, respectively. The percent (%) of paternally inherited morphological marker are computed per unique event using the number of haploid embryos divided by the total number of embryos isolated. Ears with poor fertilization (e.g., having less than a total of 50 kernels) are discarded. The mean haploid induction levels and standard deviation per plasmid are computed using observed haploid levels for all examined events per plasmid.

In comparison to sections A and B of this Example 4, it is expected that haploid parthenogenesis is improved in response to both the maternal egg cell activity provided by the plasmid within the female gametophyte and in response to the haploid induction properties provided by the pollen of the male parent. It is expected these combined activities that confer haploid parthenogenesis to the maternal egg cell result in improved maternal haploid induction in comparison to the results shown in sections A and B of this Example 4, in which the male pollen donor was a non-haploid inducer.

D. Alternative Transformation Method of Obtaining Maternal Haploid Induction in Response to ZM-ODP2 Peptide Variants The results above (section A and B) demonstrated improved maternal haploid induction in a plant stably transformed with a construct having a polynucleotide encoding an ODP2 variant, such as ZM-ODP2 (TR9), ZM-ODP2 (TR10), ZM-ODP2 (TR8), ZM-ODP2 (TR12)-linker-ZM-ODP2 (TR5)-V2, ZM-ODP2 (TR11)-linker-ZM-ODP2 (TR5)-V2, or ZM-ODP2 (TR11)-linker-ZM-ODP2 (TR12)-linker-ZM-ODP2 (TR5) (SEQ ID NO: 5-10, respectively) in comparison to ZM-ODP2 (SEQ ID NO: 1). The above results show that a construct with haploid induction capabilities integrated into a regenerated $F_1$ plant is inherited and confers a haploid induction phenotype in subsequent generations. This experiment describes a method for obtaining a regenerated $F_1$ plant with haploid induction capabilities and Cre-mediated excision of the construct providing the haploid induction capabilities, thereby providing a method for obtaining doubled haploid progeny lacking a haploid induction phenotype.

Briefly, immature embryos of a maize $F_1$ hybrid resulting from the cross of two inbred parental lines are transformed using *Agrobacterium* strain LBA4404 THY- (See U.S. Pat. No. 8,334,429 incorporated herein by reference in its entirety). Transformation is performed using an *Agrobacterium* mixture, as previously described (see US Patent Publication 20210062203 incorporated herein by reference in its entirety). An *Agrobacterium* strain containing plasmid RV020636 (SEQ ID NO: 151) is used to obtain transgenic plants with a single-copy of an integrated T-DNA from a "trait" plasmid, wherein each trait plasmid comprises a ZM-ODP2 variant (SEQ ID NO: 5-10). In this experiment, a mixture comprising 90% of the *Agrobacterium* strain having the "trait" plasmid and 10% of the *Agrobacterium* strain having the RV020636 plasmid (v/v) is used.

In this example, the "trait" plasmid comprises a first expression cassette containing a polynucleotide encoding a ZM-ODP2 variant and a second expression cassette containing a polynucleotide encoding a Cre recombinase, wherein both expression cassettes are flanked by an upstream and a downstream loxP site. For example, plasmid RV03440X (SEQ ID NO: 154) comprising an expression cassette encoding the full length ZM-ODP2 peptide and an expression cassette encoding a Cre recombinase is used as a control trait plasmid. Maternal haploid induction levels in response to plasmid RV03440X are compared to the maternal haploid induction levels observed in response to plants transformed with an experimental trait plasmid containing a ZM-ODP2 variant coding sequence. For example, experimental trait plasmids containing a polynucleotide encoding a ZM-ODP2 variant peptide can include: plasmid RZ000001 encoding ZM-ODP2 (TR9) (SEQ ID NO: 155); RZ000002 encoding ZM-ODP2 (TR10) (SEQ ID NO: 156); RZ000003 encoding ZM-ODP2 (TR8) (SEQ ID NO: 157); RZ000004 encoding ZM-ODP2 (TR12)-linker-ZM-ODP2 (TR5)-V2 (SEQ ID NO: 158); RZ000005 encoding ZM-ODP2 (TR11)-linker-ZM-ODP2 (TR5)-V2 (SEQ ID NO: 159); or RZ000006 encoding ZM-ODP2 (TR11)-linker-ZM-ODP2 (TR12)-linker-ZM-ODP2 (TR5) (SEQ ID NO: 160). In this experiment, stably transformed plants containing a trait plasmid are obtained.

Following co-infection of each embryo with a mixture comprising 90% of the *Agrobacterium* strain having the "trait" plasmid and 10% of the *Agrobacterium* strain having the RV020636 plasmid, somatic embryogenesis is activated in response to the RV020636 plasmid and somatic embryos are cultured as described herein. After approximately 6-10 days any proliferating tissue and somatic embryos are dissected and sub-cultured and each portion of dissected tissue is transferred to maturation medium (289Q) for in vitro culture at 26-28° C. under dark conditions. After approximately 6-10 days the sub-cultured tissues are transferred to a light culture room at 26° C. until healthy plantlets with good roots develop. Approximately 7-14 days later, plantlets are transferred to flats containing potting soil and grown for 1 week in a growth chamber, subsequently grown an additional 1-2 weeks in the greenhouse, and then transplanted to soil in pots and grown under greenhouse conditions.

To identify $T_0$ plants having the stably integrated T-DNA provided by the "trait" plasmid and lacking in the T-DNA of plasmid RV020636, leaf tissue is sampled per plant and is evaluated using PCR diagnostic methods. Plants lacking the RV020636 plasmid sequence that are single copy for the trait plasmid are selected, wherein each plant comprises a unique event.

Selected $T_0$ plants are grown to maturity and are used as ear donors that are fertilized with pollen from a maize inbred that is a non-haploid inducer, for example an inbred line having a wildtype patatin-like phospholipase A2 gene. Any non-haploid inducer expressing a marker gene, such as GUS, PMI, PAT, GFP, CFP, B1, C1, R-nj, and/or genes providing anthocyanin pigment activity are used. For example, a non-haploid inducer line expressing a cyan fluorescent protein (CFP) reporter gene is used in the methods disclosed herein. To measure maternal haploid induction, haploid embryos (CFP-negative embryos) are scored based on the absence of the marker gene from the paternal parent. For each event, the haploid induction level is computed by dividing the number of CFP-negative embryos by the total number of embryos sampled per event. The mean haploid induction level per construct is the average haploid induction level of all events.

In this experiment, it is expected that maternal haploid induction is increased because of improved haploid parthenogenesis responses observed in plants transformed with an experimental plasmid, such as plasmid RZ000001-RZ000006 (SEQ ID NO: 155-160) in comparison to the induction levels observed using plasmid RV03440X (SEQ ID NO: 154). It is also expected that upon Cre-mediated excision of the stably integrated "trait" construct during haploid parthenogenesis produces a plant that lacks the haploid induction trait cassette. Thus, a doubled haploid plant obtained using this method lacks an elevated level of maternal haploid induction and is expected to produce predominantly diploid seed, therefore making these plants useful for common breeding practices.

Example 5: Method Optimizing Haploid Parthenogenesis Using Modified Regulatory Elements In the methods of Example 4, each ZM-ODP2 expression cassette was operably linked to a regulatory element comprising DNA fragments named PV-EGG CELL PRO (SEQ ID NO: 31), EGG MIN PRO (SEQ ID NO: 32) and PV-PRO31696 5UTR (SEQ ID NO: 33), herein called the "PvEC1 promoter" (SEQ ID NO: 34).

As shown above, a regulatory element expressed in the egg cell of the plant is useful for regulating ZM-ODP2 peptide activity to induce maternal haploid induction, resulting in a percentage of the progeny produced being haploid (having half the number of chromosomes compared to the parent). In addition, alternative regulatory elements are used to further optimize parthenogenic maternal haploid induction levels. For example, regulatory elements such as those disclosed in US2015/0152430 (promoters including, but not limited to the AT-DD5 promoter, the AT-DD31 promoter, the AT-DD65 promoter, and the ZM-DD45) and those disclosed in US2018/0094273 (*Zea mays* egg cell promoters) are used in the methods of the present disclosure (US2015/0152430 and US2018/0094273 incorporated herein by reference in their entireties).

Expression cassettes encoding a ZM-ODP2 variant disclosed herein operably linked to a regulatory element containing at least one expression modulating element (EMVE) are useful in the methods of the present disclosure. EMEs useful in the methods of the present disclosure include, but are not limited to, those listed in Table 9.

TABLE 9

| SEQ ID NO: | Name | Size (bp) | SEQUENCE 5'-3' |
|---|---|---|---|
| 39 | EME 1 | 17 | TGACGTAAGGTATGACG |
| 40 | EME 2 | 14 | CGTAAGGTATGACG |
| 41 | EME 3 | 22 | AACAACGTAAGCGCTTACGCAC |
| 42 | EME 4 | 16 | ACGTAAGCGCTTACGC |
| 43 | EME 5 | 14 | CGTAAGCGCTTACG |

TABLE 9-continued

| SEQ ID NO: | Name | Size (bp) | SEQUENCE 5'-3' |
|---|---|---|---|
| 44 | EME 6 | 14 | CGTAAACAAATACG |
| 45 | EME 7 | 14 | CGTAAACGCTTACG |
| 46 | EME 8 | 17 | TGACGTATGGTATGACG |
| 47 | EME 9 | 14 | CGTAAGGTCTTACG |
| 48 | EME 10 | 14 | CGTAAGTCCTTACG |
| 49 | EME 11 | 14 | CGTAAGTGCTTACG |
| 50 | EME 12 | 14 | CGTAAGGCCTTACG |
| 51 | EME 13 | 14 | CGTAAGACCTTACG |
| 52 | EME 14 | 14 | CGTAAGGACTTACG |
| 53 | EME 15 | 14 | CGTAAGCACTTACG |
| 54 | EME 16 | 14 | CGTAAGGGCTTACG |
| 55 | EME 17 | 14 | CGTAAGCCCTTACG |
| 56 | EME 18 | 14 | CGTAAGTACTTACG |
| 57 | EME 19 | 14 | CGTAAGATCTTACG |
| 58 | EME 20 | 16 | GCGTAAGCGCTTACGC |
| 59 | EME 21 | 16 | AAGTAAGCGCTTACTT |
| 60 | EME 22 | 16 | ACTTAAGCGCTTAAGT |
| 61 | EME 23 | 16 | ACGGAAGCGCTTCCGT |
| 62 | EME 24 | 16 | ACGTGAGCGCTCACGT |
| 63 | EME 25 | 16 | ACGTAGGCGCCTACGT |
| 64 | EME 26 | 16 | ACGTAATCGATTACGT |
| 65 | EME 27 | 16 | GATCGGTATACCGATC |
|  | EME 28 | 8 | GCTTACGT |
|  | EME 29 | 8 | ACGTAAGC |
| 66 | EME 30 | 16 | ACGTAAGCGCTTACGT |
| 67 | EME 31 | 20 | ACAACGTAAGCGCTTACGCA |
| 68 | EME 32 | 18 | CAACGTAAGCGCTTACGC |
| 69 | EME 33 | 15 | ACGTAAGCGCTTACG |
| 70 | EME 34 | 15 | CGTAAGCGCTTACGC |
| 71 | EME 35 | 13 | CGTAAGCGCTTAC |
| 72 | EME 36 | 13 | GTAAGCGCTTACG |
| 73 | EME 37 | 10 | TAAGCGCTTA |
|  | EME 38 | 8 | AAGCGCTT |
| 74 | EME 39 | 21 | CTGACGTAAGGGATGACGCAC |
| 75 | EME 40 | 16 | GACGTAAGGTATGACG |

TABLE 9-continued

| SEQ ID NO: | Name | Size (bp) | SEQUENCE 5'-3' |
|---|---|---|---|
| 76 | EME 41 | 15 | ACGTAAGGTATGACG |
| 77 | EME 42 | 13 | GTAAGGTATGACG |
| 78 | EME 43 | 12 | TAAGGTATGACG |
| 79 | EME 44 | 21 | CTGACGTAAGCGCTTACGTAC |
| 80 | EME 45 | 21 | CTGACGTAAGCGCTGACGTAC |
| 81 | EME 46 | 21 | CTGACGTAAGCGCTGACGCAC |
| 82 | EME 47 | 16 | ACGTAAGCGATTACGT |
| 83 | EME 48 | 21 | CTGACGTAAGCGATTACGCAC |
| 84 | EME 49 | 21 | CTGACGTAAGCGATTACGTAC |
| 85 | EME 50 | 21 | CTGACGTAAGGGATTACGTAC |
| 86 | EME 51 | 22 | AATGACGTAAGCGCTTACGCAC |
| 87 | EME 52 | 22 | AATGACGTAAGCGCTGACGCAC |
| 88 | EME 53 | 12 | CGTAAGGTATGA |
| 89 | EME 54 | 12 | GTAAGGTATGAC |
| 90 | EME 55 | 12 | GACGTAAGGTAT |
| 91 | EME 56 | 13 | ACGTAAGGTATGA |
| 92 | EME 57 | 13 | CGTAAGGTATGAC |
| 93 | EME 58 | 13 | GACGTAAGGTATG |
| 94 | EME 59 | 14 | ACGTAAGGTATGAC |
| 95 | EME 60 | 14 | GACGTAAGGTATGA |
| 96 | EME 61 | 15 | GACGTAAGGTATGAC |
| 97 | EME 62 | 11 | TAAGCGCTTAC |
| 98 | EME 63 | 12 | GTAAGCGCTTAC |
| 99 | EME 64 | 12 | TAAGCGCTTACG |
| 100 | EME 65 | 14 | GTAAGCGCTTACGC |
| 101 | EME 66 | 16 | AACGTAAGCGCTTACG |
| 102 | EME 67 | 16 | ACGTAAGCGCTTACGA |
| 103 | EME 68 | 16 | ACGTAAGCGCTTACGG |

Expression cassettes encoding ZM-ODP2 variants operably linked to a regulatory element containing at least one expression modulating element (EME) and/or an enhancer can also be used in the methods of the present disclosure. Enhancers useful in the methods of the present disclosure are listed in Table 10.

TABLE 10

| SEQ ID NO: | Description |
|---|---|
| 104 | CaMV35S Enhancer (CAMV35S ENH) |
| 105 | Citrus Yellow Mosaic Virus Enhancer (CYMV ENH) |
| 106 | Banana Streak Virus Enhancer (BSV(AY) ENH) |
| 107 | Figwort Mosaic Virus Enhancer (FMV ENH) |
| 108 | Peanut Chlorotic Streak Virus Enhancer (PCSV ENH) |
| 109 | Mirabilis Mosaic Virus Enhancer (MMV ENH) |

It is expected that an alternative "PvEC promoter" (SEQ ID NO: 34) including at least one EML (see Table 9) and/or at least one enhancer (see Table 10) is used to alter mRNA transcription levels during female gametogenesis, thereby further improving and/or optimizing parthenogenic maternal haploid induction in comparison to ZM-ODP2 variant operably linked to a regulatory element comprising DNA fragments named PV-EGG CELL PRO (SEQ ID NO: 31), EGG MIN PRO (SEQ ID NO: 32) and PV-PR031696 5UTR (SEQ ID NO: 33), herein called the "PvEC1 promoter" (SEQ ID NO: 34) as shown in Example 4.

For example, exemplary promoters are shown in Table 11. As shown in Table 11, the "PvEC1 promoter" (SEQ ID NO: 34) is modified using the ZM-AS2 EME having one, two, or three copies, shown as 1×ZM-AS2, 2×ZM-AS2, and 3×ZM-AS2, respectively, at varying positions. The EMIL location indicates the number of DNA base pairs upstream of the TATA box where each respective EM sequence is inserted. The TATA sequence used for each promoter is shown in the TATA box column.

TABLE 11

| SEQ ID NO: | Regulatory Element | Promoter Source | EME | EME location | TATA box |
|---|---|---|---|---|---|
| 34 | PvEC1 PRO | PV-EGG CELL PRO | not applicable | not applicable | TATATATA |
| 121 | PvEC1: (1X ZM-AS2-20) | PV-EGG CELL PRO | 1X ZM-AS2 | −20 | TATATATA |
| 122 | PvEC1: (2X ZM-AS2-20) | PV-EGG CELL PRO | 2X ZM-AS2 | −20 | TATATATA |
| 123 | PvEC1: (3X ZM-AS2-20) | PV-EGG CELL PRO | 3X ZM-AS2 | −20 | TATATATA |
| 124 | PvEC1: (2X ZM-AS2-60) | PV-EGG CELL PRO | 2X ZM-AS2 | −60 | TATATATA |
| 125 | PvEC1: (2X ZM-AS2-100) | PV-EGG CELL PRO | 2X ZM-AS2 | −100 | TATATATA |
| 126 | PvEC1: (2X ZM-AS2-20) | PV-EGG CELL PRO | 2X ZM-AS2 | −20 | TATAA |
| 127 | PvEC1: (2X ZM-AS2-60) | PV-EGG CELL PRO | 2X ZM-AS2 | −60 | TATAA |

It is expected the modified regulatory elements shown in Table 11 are used to alter mRNA transcription levels during female gametogenesis, thereby further improving and/or optimizing parthenogenic maternal haploid induction in comparison to ZM-ODP2 variants operably linked to a regulatory element comprising DNA fragments named PV-EGG CELL PRO (SEQ ID NO: 31), EGG MIN PRO (SEQ ID NO: 32) and PV-PRO31696 5UTR (SEQ ID NO: 33), herein called the "PvEC1 promoter" (SEQ ID NO: 34) as described in Example 4.

The methods of the present disclosure may also use different promoters with or without the EME sequences shown in Table 9 and/or the enhancers shown in Table 10. Synthetic promoters comprised of fragments of natural promoters are useful in the methods of the present disclosure. Such synthetic promoters are designed to regulate the activity of genes, for example, to improve haploid parthenogenesis as described herein.

Natural promoters and fragments thereof used herein for creating synthetic promoters include the PvEC1 promoter (SEQ ID NO: 34), a *Zea mays* egg cell promoter, "ZM-EXP31554 PRO" (SEQ ID NO: 128), and a *Triticum aestivum* egg cell promoter, "TA-EC PRO" (SEQ ID NO: 129), The PvEC1 promoter (SEQ ID NO: 34) is used as the core promoter and other DNA fragments from the *Zea mays* egg cell promoter, "ZM-EXP31554 PRO" (SEQ ID NO: 128) or the *Triticum aestivum* egg cell promoter, "TA-EC PRO" (SEQ ID NO: 129) are used for at least one upstream activation region (UAR) in the synthetic promoters described in Table 12.

TABLE 12

| SEQ ID NO: | Regulatory Element | UAR2 | UAR1 | Core Promoter |
|---|---|---|---|---|
| 34 | PvEC1 PRO | | | PV-EGG CELL PRO |
| 128 | ZM-EXP31554 PRO | | | ZM-EXP31554 PRO |
| 129 | TA-EC PRO | | | TA-EC PRO |
| 130 | SynPRO_04 | | TA-EC UAR | PV-EGG CELL PRO |
| 131 | SynPRO_05 | | ZM-EXP31554 UAR | PV-EGG CELL PRO |
| 132 | SynPRO_06 | TA-EC UAR | ZM-EXP31554 UAR | PV-EGG CELL PRO |
| 133 | SynPRO_07 | ZM-EXP31554 UAR | TA-EC UAR | PV-EGG CELL PRO |
| 134 | SynPRO_08 | PV-EGG CELL UAR | TA-EC UAR | ZM-EXP31554 PRO |
| 135 | SynPRO_09 | TA-EC UAR | PV-EGG CELL UAR | ZM-EXP31554 PRO |

It is expected the synthetic promoters shown in Table 12 (SynPRO_04, SynPRO_05, SynPRO_06, SynPRO_07, SynPRO_08, SynPRO_09) will alter mRNA transcription levels during female gametogenesis, thereby further improving and/or optimizing parthenogenic maternal haploid induction in comparison to ZM-ODP2 variants operably linked to a regulatory element comprising DNA fragments named PV-EGG CELL PRO (SEQ ID NO: 31), EGG MIN PRO (SEQ ID NO: 32) and PV-PRO31696 5UTR (SEQ ID NO: 33), herein called the "PvEC1 promoter" (SEQ ID NO: 34) as shown in Example 4.

Further, it is expected that the synthetic promoters shown in Table 12 when combined with the EMEs of Table 9 and/or the enhancers of Table 10 will result in further improvements and/or optimization of parthenogenic maternal haploid induction in comparison to ZM-ODP2 variants operably linked to a regulatory element comprising DNA fragments named PV-EGG CELL PRO (SEQ ID NO: 31), EGG MIN PRO (SEQ ID NO: 32) and PV-PRO31696 5UTR (SEQ ID NO: 33), herein called the "PvEC1 promoter" (SEQ ID NO: 34) as shown in Example 4.

Example 6: Discovery of Additional Parthenogenesis Factors

The yeast two-hybrid (Y2H) system was used to identify proteins interacting with motif "A" comprising the ZM-ODP2(TR12) DNA fragment (SEQ ID NO: 35) encoding the motif A peptide fragment (SEQ ID NO: 36) and/or proteins interacting with motif "B" comprising the ZM-ODP2(TR11) DNA fragment (SEQ ID NO: 37) encoding the motif B peptide fragment (SEQ ID NO: 38) for use of such identified proteins as parthenogenesis factors (PFs).

The Y2H system is used to identify specific protein interactions in vivo. Specifically, in the Y2H system, two fusion proteins are expressed in yeast cells. The first fusion protein has a DNA-binding domain of a transcriptional activator fused to a test protein, herein referred to as a "bait" protein. The second fusion protein includes a transcriptional activating domain of the transcriptional activator fused to another test protein. If the two test proteins interact with each other in vivo, the two domains of the transcriptional activator are brought together reconstituting the transcriptional activator and activating a reporter gene controlled by the transcriptional activator.

A first bait protein (SEQ ID NO: 119), herein called the "ZM-ODP2 bait 1", had a polynucleotide comprising ZM-ODP2 (TR5) (SEQ ID NO: 2) to create a test protein comprising the ZM-ODP2-(266-669) peptide variant (SEQ ID NO: 12). The second bait protein, (SEQ ID NO: 120), herein called the "ZM-ODP2 bait 2", had a polynucleotide comprising the ZM-ODP2 (TR11)-linker-ZM-ODP2 (TR12)-linker-ZM-ODP2 (TR5) (SEQ ID NO: 10) to create a test protein comprising the ZM-ODP2-(60-69)-(156-171)-(266-669) peptide variant (SEQ ID NO: 20). Each bait protein (ZM-ODP2 bait 1 and ZM-ODP2 bait 2) exhibited a degree of toxicity in yeast, and thus, each polynucleotide encoding a bait test protein was inserted into an inducible vector and is used as follows. Each bait protein was tested in the absence or presence of a dose-range of 3-aminotriazol (3-AT) to lower background levels and initial testing will evaluate whether a bait protein autoactivates an imidazole glycerolphosphate dehydratase (HIS3) gene reporter.

An optimized version of the Y2H system available from Hybrigenics Corporation (Cambridge, MA) (see US2003/0134268, incorporated herein by reference in its entirety) was used to identify proteins interacting with each "bait" protein described above using the Hybrigenics Corn (*Zea mays*)-Leaf and ovary ref:[MALO] library. Specifically, a "prey" protein comprises a polynucleotide of the Hybrigenics Corn (*Zea mays*)-Leaf and ovary ref:[MALO] library fused to a transcriptional activation domain, for example the Gal4 domain that recognizes and binds to an upstream activation sequence and positively regulates gene expression. A protein interaction between a "bait" protein and a "prey" protein was identified when the two are brought together thereby reconstituting the transcriptional activator that activates a reporter gene controlled by the transcriptional activator. The identity of the "prey" interacting partners was obtained by sequencing the corresponding plasmids in the selected yeast colonies and the corresponding full-length proteins were identified using proprietary gene model annotations.

A total of 139 parthenogenesis factors (PFs) were identified by protein interactions using ZM-ODP2 bait 1 protein (dataset hgx5639) and ZM-ODP2 bait 2 protein (dataset hgx5640) (see Table 13). Of these 139 parthenogenesis factors (PFs), 15 PFs were associated with yeast two hybrid interactions common to both the ZM-ODP2 bait 1 protein and the ZM-ODP2 bait 2 protein (see Table 13; Y2H association "both"); 47 PFs were associated with yeast two hybrid interactions unique to the ZM-ODP2 bait 1 protein (see Table 13; Y2H association "hgx5639"); and 77 PFs were associated with yeast two hybrid interactions unique to the ZM-ODP2 bait 2 protein (see Table 13; Y2H association "hgx5640").

TABLE 13

| Parthenogenesis Factor (PF) | DNA SEQ ID NO: | PRT SEQ ID NO: | Y2H association | Y2H count |
|---|---|---|---|---|
| dpzm01g012740.1.1 | 165 | 304 | both | 1 |
| dpzm01g018470.1.1 | 166 | 305 | both | 2 |
| dpzm01g024080.1.1 | 167 | 306 | both | 3 |
| dpzm01g050420.1.1 | 168 | 307 | both | 4 |
| dpzm02g002600.1.1 | 169 | 308 | both | 5 |
| dpzm03g003630.1.1 | 170 | 309 | both | 6 |
| dpzm03g020580.1.1 | 171 | 310 | both | 7 |
| dpzm04g044180.1.1 | 172 | 311 | both | 8 |
| dpzm04g067730.1.1 | 173 | 312 | both | 9 |
| dpzm05g042820.1.1 | 174 | 313 | both | 10 |
| dpzm08g013550.1.1 | 175 | 314 | both | 11 |
| dpzm09g008930.1.1 | 176 | 315 | both | 12 |
| dpzm09g017360.1.1 | 177 | 316 | both | 13 |
| dpzm09g037390.1.1 | 178 | 317 | both | 14 |
| dpzm09g047250.1.1 | 179 | 318 | both | 15 |
| dpzm01g005960.1.1 | 180 | 319 | hgx5639 | 1 |
| dpzm01g014590.1.1 | 181 | 320 | hgx5639 | 2 |
| dpzm01g040830.1.1 | 182 | 321 | hgx5639 | 3 |
| dpzm01g055550.1.1 | 183 | 322 | hgx5639 | 4 |
| dpzm01g066210.1.1 | 184 | 323 | hgx5639 | 5 |
| dpzm01g091780.1.1 | 185 | 324 | hgx5639 | 6 |
| dpzm02g000400.1.1 | 186 | 325 | hgx5639 | 7 |
| dpzm02g010870.1.1 | 187 | 326 | hgx5639 | 8 |
| dpzm02g030750.1.1 | 188 | 327 | hgx5639 | 9 |
| dpzm02g042420.1.1 | 189 | 328 | hgx5639 | 10 |
| dpzm02g053170.1.1 | 190 | 329 | hgx5639 | 11 |
| dpzm02g076770.1.1 | 191 | 330 | hgx5639 | 12 |
| dpzm03g000770.1.1 | 192 | 331 | hgx5639 | 13 |
| dpzm03g007060.1.1 | 193 | 332 | hgx5639 | 14 |
| dpzm03g032240.1.1 | 194 | 333 | hgx5639 | 15 |
| dpzm03g036660.1.1 | 195 | 334 | hgx5639 | 16 |
| dpzm03g055960.1.1 | 196 | 335 | hgx5639 | 17 |
| dpzm03g059840.1.1 | 197 | 336 | hgx5639 | 18 |
| dpzm04g017080.1.1 | 198 | 337 | hgx5639 | 19 |
| dpzm04g020460.1.1 | 199 | 338 | hgx5639 | 20 |

TABLE 13-continued

| Parthenogenesis Factor (PF) | DNA SEQ ID NO: | PRT SEQ ID NO: | Y2H association | Y2H count |
|---|---|---|---|---|
| dpzm05g000470.1.1 | 200 | 339 | hgx5639 | 21 |
| dpzm05g000950.1.1 | 201 | 340 | hgx5639 | 22 |
| dpzm05g024060.1.1 | 202 | 341 | hgx5639 | 23 |
| dpzm05g038820.1.1 | 203 | 342 | hgx5639 | 24 |
| dpzm05g047480.1.1 | 204 | 343 | hgx5639 | 25 |
| dpzm05g058970.1.1 | 205 | 344 | hgx5639 | 26 |
| dpzm05g065800.1.1 | 206 | 345 | hgx5639 | 27 |
| dpzm05g069270.1.1 | 207 | 346 | hgx5639 | 28 |
| dpzm06g008320.1.1 | 208 | 347 | hgx5639 | 29 |
| dpzm06g041220.1.1 | 209 | 348 | hgx5639 | 30 |
| dpzm06g045220.1.1 | 210 | 349 | hgx5639 | 31 |
| dpzm06g057830.1.1 | 211 | 350 | hgx5639 | 32 |
| dpzm07g014690.1.1 | 212 | 351 | hgx5639 | 33 |
| dpzm07g018790.1.1 | 213 | 352 | hgx5639 | 34 |
| dpzm07g030520.1.1 | 214 | 353 | hgx5639 | 35 |
| dpzm07g047640.1.1 | 215 | 354 | hgx5639 | 36 |
| dpzm08g028220.1.1 | 216 | 355 | hgx5639 | 37 |
| dpzm08g028860.1.1 | 217 | 356 | hgx5639 | 38 |
| dpzm08g036180.1.1 | 218 | 357 | hgx5639 | 39 |
| dpzm08g038480.1.1 | 219 | 358 | hgx5639 | 40 |
| dpzm09g006520.1.1 | 220 | 359 | hgx5639 | 41 |
| dpzm09g042170.1.1 | 221 | 360 | hgx5639 | 42 |
| dpzm09g043730.1.1 | 222 | 361 | hgx5639 | 43 |
| dpzm09g044010.1.1 | 223 | 362 | hgx5639 | 44 |
| dpzm09g046840.1.1 | 224 | 363 | hgx5639 | 45 |
| dpzm10g001100.1.1 | 225 | 364 | hgx5639 | 46 |
| dpzm10g046050.1.1 | 226 | 365 | hgx5639 | 47 |
| dpzm00g100506.1.1 | 227 | 366 | hgx5640 | 1 |
| dpzm00g105498.1.1 | 228 | 367 | hgx5640 | 2 |
| dpzm01g030480.1.1 | 229 | 368 | hgx5640 | 3 |
| dpzm01g038380.1.1 | 230 | 369 | hgx5640 | 4 |
| dpzm01g041900.1.1 | 231 | 370 | hgx5640 | 5 |
| dpzm01g047060.1.1 | 232 | 371 | hgx5640 | 6 |
| dpzm01g064980.1.1 | 233 | 372 | hgx5640 | 7 |
| dpzm01g069460.1.1 | 234 | 373 | hgx5640 | 8 |
| dpzm01g076810.1.1 | 235 | 374 | hgx5640 | 9 |
| dpzm01g082010.1.1 | 236 | 375 | hgx5640 | 10 |
| dpzm01g089820.1.1 | 237 | 376 | hgx5640 | 11 |
| dpzm01g090870.1.1 | 238 | 377 | hgx5640 | 12 |
| dpzm01g100120.1.1 | 239 | 378 | hgx5640 | 13 |
| dpzm01g102400.1.1 | 240 | 379 | hgx5640 | 14 |
| dpzm01g103940.1.1 | 241 | 380 | hgx5640 | 15 |
| dpzm02g000910.1.1 | 242 | 381 | hgx5640 | 16 |
| dpzm02g004780.1.1 | 243 | 382 | hgx5640 | 17 |
| dpzm02g017010.1.1 | 244 | 383 | hgx5640 | 18 |
| dpzm02g020410.1.1 | 245 | 384 | hgx5640 | 19 |
| dpzm02g030700.1.1 | 246 | 385 | hgx5640 | 20 |
| dpzm02g045800.1.1 | 247 | 386 | hgx5640 | 21 |
| dpzm02g048730.1.1 | 248 | 387 | hgx5640 | 22 |
| dpzm02g068080.1.1 | 249 | 388 | hgx5640 | 23 |
| dpzm02g072620.1.1 | 250 | 389 | hgx5640 | 24 |
| dpzm03g003570.1.1 | 251 | 390 | hgx5640 | 25 |
| dpzm03g003710.1.1 | 252 | 391 | hgx5640 | 26 |
| dpzm03g004630.1.1 | 253 | 392 | hgx5640 | 27 |
| dpzm03g004810.1.1 | 254 | 393 | hgx5640 | 28 |
| dpzm03g006960.1.1 | 255 | 394 | hgx5640 | 29 |
| dpzm03g014270.1.1 | 256 | 395 | hgx5640 | 30 |

TABLE 13-continued

| Parthenogenesis Factor (PF) | DNA SEQ ID NO: | PRT SEQ ID NO: | Y2H association | Y2H count |
|---|---|---|---|---|
| dpzm03g015560.1.1 | 257 | 396 | hgx5640 | 31 |
| dpzm03g028370.1.1 | 258 | 397 | hgx5640 | 32 |
| dpzm03g034070.1.1 | 259 | 398 | hgx5640 | 33 |
| dpzm03g041360.1.1 | 260 | 399 | hgx5640 | 34 |
| dpzm03g068360.1.1 | 261 | 400 | hgx5640 | 35 |
| dpzm04g009050.1.1 | 262 | 401 | hgx5640 | 36 |
| dpzm04g011540.1.1 | 263 | 402 | hgx5640 | 37 |
| dpzm04g023950.1.1 | 264 | 403 | hgx5640 | 38 |
| dpzm05g018360.1.1 | 265 | 404 | hgx5640 | 39 |
| dpzm05g026370.1.1 | 266 | 405 | hgx5640 | 40 |
| dpzm05g032870.1.1 | 267 | 406 | hgx5640 | 41 |
| dpzm05g035100.1.1 | 268 | 407 | hgx5640 | 42 |
| dpzm05g049450.1.1 | 269 | 408 | hgx5640 | 43 |
| dpzm05g068110.1.1 | 270 | 409 | hgx5640 | 44 |
| dpzm05g069160.1.1 | 271 | 410 | hgx5640 | 45 |
| dpzm05g070990.1.1 | 272 | 411 | hgx5640 | 46 |
| dpzm06g033540.1.1 | 273 | 412 | hgx5640 | 47 |
| dpzm06g036930.1.1 | 274 | 413 | hgx5640 | 48 |
| dpzm06g041470.1.1 | 275 | 414 | hgx5640 | 49 |
| dpzm06g045820.1.1 | 276 | 415 | hgx5640 | 50 |
| dpzm06g053400.1.1 | 277 | 416 | hgx5640 | 51 |
| dpzm06g054380.1.1 | 278 | 417 | hgx5640 | 52 |
| dpzm06g057470.1.1 | 279 | 418 | hgx5640 | 53 |
| dpzm07g001190.1.1 | 280 | 419 | hgx5640 | 54 |
| dpzm07g004060.1.1 | 281 | 420 | hgx5640 | 55 |
| dpzm07g009950.1.1 | 282 | 421 | hgx5640 | 56 |
| dpzm07g018160.1.1 | 283 | 422 | hgx5640 | 57 |
| dpzm07g037580.1.1 | 284 | 423 | hgx5640 | 58 |
| dpzm07g047520.1.1 | 285 | 424 | hgx5640 | 59 |
| dpzm08g008180.1.1 | 286 | 425 | hgx5640 | 60 |
| dpzm08g018800.1.1 | 287 | 426 | hgx5640 | 61 |
| dpzm08g033120.1.1 | 288 | 427 | hgx5640 | 62 |
| dpzm08g044200.1.1 | 289 | 428 | hgx5640 | 63 |
| dpzm08g050470.1.1 | 290 | 429 | hgx5640 | 64 |
| dpzm08g050740.1.1 | 291 | 430 | hgx5640 | 65 |
| dpzm08g053700.1.1 | 292 | 431 | hgx5640 | 66 |
| dpzm09g004220.1.1 | 293 | 432 | hgx5640 | 67 |
| dpzm09g035980.1.1 | 294 | 433 | hgx5640 | 68 |
| dpzm09g042840.1.1 | 295 | 434 | hgx5640 | 69 |
| dpzm09g043040.1.1 | 296 | 435 | hgx5640 | 70 |
| dpzm09g050260.1.1 | 297 | 436 | hgx5640 | 71 |
| dpzm10g001170.1.1 | 298 | 437 | hgx5640 | 72 |
| dpzm10g008580.1.1 | 299 | 438 | hgx5640 | 73 |
| dpzm10g018850.1.1 | 300 | 439 | hgx5640 | 74 |
| dpzm10g030160.1.1 | 301 | 440 | hgx5640 | 75 |
| dpzm10g040610.1.1 | 302 | 441 | hgx5640 | 76 |
| dpzm10g043100.1.1 | 303 | 442 | hgx5640 | 77 |

It is expected that the identification of parthenogenesis factors that share interactions with the ZM-ODP2 bait 2 protein and the ZM-ODP2 bait 1 protein are useful in haploid parthenogenesis induction to modulate the activity of parthenogenesis factors or when used in combination with the ODP2 variant parthenogenesis factors disclosed herein.

It is expected that haploid parthenogenesis is improved by providing to a cell, such as an egg cell, the activity of a ZM-ODP2 peptide, including a ZM-ODP2 peptide variant, for example, variants described in Table 5 while modulating the activity of the parthenogenesis factors shown in Table 13.

Example 7: Altered Haploid Parthenogenesis Using a ZM-ODP2 Peptide Variant and an Additional Parthenogenesis Factor It is expected that haploid parthenogenesis is modulated by providing the activity of a parthenogenesis factor to a female gametophyte, such as an egg cell. It is expected that the parthenogenesis factors, identified in Table 13 using a library comprising polynucleotides encoding transcripts obtained from both leaf and ovary tissues, are capable of interacting with an ODP2 peptide in a manner that can potentially activate or suppress ODP2 activity, and thus, are expected to alter haploid parthenogenesis.

Haploid parthenogenesis was evaluated by providing the activity of a parthenogenesis factor, for example, a peptide such as those shown in Table 13, to a female gametophyte, such as an egg cell, in combination with an ODP2 peptide. Haploid parthenogenesis was observed using a control plasmid RV036695 (SEQ ID NO: 30) containing a polynucleotide encoding ZM-ODP2 variant 8. In addition, the plasmids described in Table 14 were used for transformation as described in Example 3. Haploid parthenogenesis was measured as described in Example 4 A.

Additional expression cassettes containing a polynucleotide encoding a parthenogenesis factor (PF) and/or a ZM-ODP2 peptide variant operably linked to a regulatory element such as the "PvEC1 promoter" (SEQ ID NO: 34) as shown in Example 4 and/or operably linked to a regulatory element as described in Example 5, including, but not limited to, an EME listed in Table 9, and/or an enhancer listed in Table 10, and/or a promoter listed in Table 11 and/or Table 12 is constructed and used in the methods disclosed herein.

TABLE 14

| Plasmid | Plasmid DNA SEQ ID NO: | ODP2 activity | Parthenogenesis Factor activity | Haploid Parthenogenesis (mean %) | Probability of being equal to RV036695 |
|---|---|---|---|---|---|
| RV036695 | 30 | ZM-ODP2 variant 8 | na | 34.3 | |
| RV044486 | 502 | ZM-ODP2 variant 8 | dpzm08g008180 | 21.2 | $p < 0.0001$ |
| RV044827 | 503 | ZM-ODP2 variant 8 | dpzm04g011540 | 26.3 | $p < 0.0058$ |
| RV044485 | 504 | ZM-ODP2 variant 8 | dpzm01g082010 | 26 | $p < 0.0009$ |
| RV044675 | 505 | ZM-ODP2 variant 8 | dpzm10g040610 | 27.8 | $p < 0.0059$ |

The level of haploid parthenogenesis observed in response to the co-expression of a ZM-ODP2 variant 8 peptide and a parthenogenesis factor peptide was decreased in comparison to the level of haploid parthenogenesis observed in response to the expression of the ZM-ODP2 variant 8 peptide alone. These results showed that the co-expressed protein combinations decreased haploid parthenogenesis to varying degrees (see Table 14). This decrease in haploid parthenogenesis may have been caused by the parthenogenesis factors modulating ODP2 activity, for example, by modulating protein stability of the ODP2 transcription factor, by modulating ODP2 interactions with another protein, or proteins as modular components of a protein complex, and/or by modulating other types of interactions, including, but not limited to, protein-DNA, protein-RNA, protein-cofactor, and/or protein-ligand interactions.

It is therefore expected that improved haploid parthenogenesis is achieved by providing to a female gametophyte, such as an egg cell, the combined activity of a ZM-ODP2 peptide, such as ZM-ODP2 variant 8, and a repressor of the locus, or loci, conferring the parthenogenesis factor gene product. It is expected that increased haploid parthenogenesis is achieved when ZM-ODP2 peptide activity is provided to a plant cell, whereby the interacting proteins that were shown to reduce haploid parthenogenesis are repressed.

Example 8: Improved Method for Obtaining a Genome-Modified Maternal Doubled Haploid Plant Methods of the present disclosure relate to creating genome-modifying haploid inducer lines by transforming a non-haploid inducer line to express a ZM-ODP2 variant peptide component and a gene editing component. The activities of these components are provided to a maternal haploid embryo of a plant to obtain a gene edited maternal haploid embryo.

The haploid parthenogenesis induction/gene editing methods used herein comprise the gene editing activity with the activity of a ZM-ODP2 variant (parthenogenesis factor) and/or the activity of an additional parthenogenesis factor identified in Example 6, or any combination thereof. These components may be regulated in a tissue-specific manner, for example operably linked to a promoter active in an egg cell, such as the "PvEC1 promoter" (SEQ ID NO: 34) as shown in Example 4 or operably linked to a regulatory element as described in Example 5, including but not limited to an EME listed in Table 9, and/or an enhancer listed in Table 10, and/or a promoter listed in Table 11 and/or Table 12, thereby conferring simultaneous haploid parthenogenesis and gene editing.

The methods of this Example 8 follow similar principles as demonstrated in the above Examples. First, immature embryos are transformed, for example, using an immature diploid embryo having a first filial generation ($F_1$), or hybrid, genome as described in Example 4, wherein the diploid embryo comprises chromosomes inherited from two parental lines. The transformed plant is then expected to create genetically diverse gametes of interest for breeding purposes.

The $F_1$ embryo is transformed with a construct containing a polynucleotide with loxP sites flanking a sequence containing three components comprising a haploid induction component, wherein the transformed plant activates haploid parthenogenesis in an unfertilized embryo; a gene modification component, wherein the parthenogenic embryo can have a genome modification such as a mutation, deletion, insertion, substitution or a gene targeting event via homology directed DNA repair; and third, a Cre recombinase component useful for gene excision is provided to the genome modified parthenogenic embryo. A haploid embryo having a genome modification at a genomic target site and Cre-mediated excision of the construct polynucleotide between the two loxP sites is obtained.

Methods of using a particular nuclease, Cas9, are described herein. Alternative Cas nucleases that provide double strand break activity are useful in the methods of the present disclosure. Such nucleases can be programmed to derive other types of genome modification, such as a targeted deletion (e.g. sequence "drop-out") resulting from two adjacent double strand breaks followed by non-homologous end joining that excludes the intervening DNA sequence between the two double strand break sites. Additionally, small deletions/additions generated as a result of introducing into a cell a repair DNA template (donor DNA) homologous to the targeted area (SDN-2) are useful in the methods of the disclosure.

A. Improved Method for Obtaining a Gene-Edited Doubled Haploid Plant

A Cas9-mediated SDN-1 method produces a double-stranded break in the genome of a plant without the addition of foreign DNA. The spontaneous repair of this break can lead to a mutation or deletion, causing gene silencing, gene knock-out or a change in the activity of a gene. To demonstrate this Cas9-mediated SDN-1 method, the RV034409 (Trait Control), RA000007 (Trait Test 7), RA000008 (Trait Test 8), RA000009 (Trait Test 9), RA0000010 (Trait Test 10), RA0000011 (Trait Test 11), RA0000012 (Trait Test 12) plasmids are used containing the following components: a haploid induction expression cassette with a polynucleotide encoding a full-length ZM-ODP2 protein (Trait Control) or a polynucleotide encoding a ZM-ODP2 variant protein (Trait Test 7-12) operably linked to the "PvEC1 promoter" (SEQ ID NO: 34); a SV40 NLS-Cas9-VIRD2 fusion protein operably linked to a ZM-EXP31554 promoter; a gRNA expression cassettes operably linked to *Zea mays* RNA polymerase III promoter sequences required for cleaving a target site at ZM-NAC7 (SEQ ID NO: 136); a DsRED fluorescent protein operably linked a constitutive promoter; and a maize-optimized Cre recombinase protein operably linked to the "PvEC1 promoter" (SEQ ID NO: 34). LoxP sites flank the above expression cassettes to allow CRE-mediated excision of the intervening polynucleotide.

Plasmid RV034409 (Trait Control) provided Cas9 activity during haploid parthenogenesis to create a double strand break at the NAC7 target site, wherein spontaneous repair of this break lead to a change, such as a mutation or deletion. Those previous results indicated up to 68% of the obtained haploid plants showed evidence of SDN-1 editing at the ZM-NAC7 target site.

It is expected that SDN-1 editing is improved when the ZM-ODP2 variants disclosed herein which confer improved haploid parthenogenesis are used in combination with SDN-1 genome modification components. Briefly, immature embryos of a maize $F_1$ hybrid resulting from the cross of two inbred parental lines are transformed using *Agrobacterium* strain LBA4404 THY- (see U.S. Pat. No. 8,334,429 incorporated herein by reference in its entirety). Transformation is performed using an *Agrobacterium* mixture, as previously described (see US Patent Publication 20210062203 incorporated herein by reference in its entirety). Transformation with an *Agrobacterium* strain containing the RV020636 plasmid (SEQ ID NO: 151) is used to obtain transgenic plants having a single-copy of an integrated T-DNA from a "trait" plasmid, wherein each plasmid comprises a ZM- ODP2 variant (SEQ ID NO:1 and 5-10) (see Table 15). Specifically, the transformation is performed with a mixture comprising 90% of the *Agrobacterium* strain having the "trait" plasmid and 10% of the RV020636 plasmid (v/v).

TABLE 15

| SEQ ID NO: | Plasmid | ZM-ODP2(Trait Control or Trait Test) | ZM-ODP2 SEQ ID NO: |
|---|---|---|---|
| 137 | RV034409 | ZM-ODP2 (Trait Control) | 1 |
| 138 | RA000007 | ZM-ODP2 (TR9) (Trait Test 7) | 5 |
| 139 | RA000008 | ZM-ODP2 (TR10) (Trait Test 8) | 6 |
| 140 | RA000009 | ZM-ODP2 (TR8) (Trait Test 9) | 7 |
| 141 | RA000010 | ZM-ODP2 (TR12)-linker-ZM-ODP2 (TR5)-V2 (Trait Test 10) | 8 |
| 142 | RA000011 | ZM-ODP2 (TR11)-linker-ZM-ODP2 (TR5)-V2 (Trait Test 11) | 9 |
| 143 | RA000012 | ZM-ODP2 (TR11)-linker-ZM-ODP2 (TR12)-linker-ZM-ODP2 (TR5) (Trait Test 12) | 10 |

Following co-infection of each embryo, somatic embryogenesis is activated in response to the RV020636 plasmid activity and somatic embryos are cultured as described in Example 3 with the inclusion of a chromosome doubling step, such as contacting a plant cell with colchicine at a concentration of about 0.1 to about 1.0 g/ml for a period of 24 hours before transfer to a resting medium (605J) that is lacking the chromosome doubling treatment. Alternatively, the chromosome doubling step is performed at a later time, such as using a root soaking method.

After approximately 6-10 days any proliferating tissue and somatic embryos are dissected and sub-cultured, wherein each portion of dissected tissue is transferred to maturation medium (289Q) for in vitro culture at 26-28° C. under dark conditions. After approximately 6-10 days the sub-cultured tissues are transferred to a light culture room at 26° C. until healthy plantlets with good roots develop. Approximately 7-14 days later, plantlets are transferred to flats containing potting soil and grown for 1 week in a growth chamber, plantlets are subsequently grown an additional 1-2 weeks in the greenhouse, and then transplanted to soil in pots and grown under greenhouse conditions.

To identify $T_0$ plants having the stably integrated T-DNA provided by the "trait" plasmid and lacking in the T-DNA of RV020636 plasmid, leaf tissue is sampled per plant and is evaluated using PCR diagnostic methods. Plants lacking the RV020636 plasmid sequence that are single copy for the trait plasmid in Table 15 are selected, wherein each plant comprises a unique event.

Selected $T_0$ plants are grown to maturity and are used as ear donors that are fertilized with pollen from a maize inbred that is a non-haploid inducer, for example an inbred line having a wildtype patatin-like phospholipase A2 gene. In particular, the method of the present disclosure uses a non-haploid inducer expressing a marker gene, such as GUS, PMI, PAT, GFP, CFP, B1, C1, R-nj, and/or genes providing anthocyanin pigment activity. For example, a non-haploid inducer line expressing a cyan fluorescent protein (CFP) reporter gene is used in the methods disclosed herein. Haploid embryos, CFP-negative embryos, are thus scored based on the absence of the marker gene from the paternal parent to measure maternal haploid induction in response to parthenogenic gene activity provided to the unfertilized egg cell by the "trait" T-DNA. For each event, the haploid induction level is computed by dividing the number of CFP-negative embryos by the total number of embryos sampled per event. The mean haploid induction per construct is the average haploid induction level of all events.

It is expected that plants having a "trait" plasmid (see Table 15 Trait Test 7-12, SEQ ID NO: 138-143) will have an improved frequency of a gene edited doubled haploid plant in comparison to the frequency of gene edited doubled haploid plants obtained using plasmid RV034409 (see Table 15 Trait Control SEQ ID NO: 137).

B. Improved Method for Crispr/Cas9-Mediated Gene Targeting of Doubled Haploids

A Cas9-mediated SDN-3 method induces a double-stranded break in the DNA and is accompanied by a template containing a gene or other sequence of genetic material. The cell's natural repair process then utilizes this template to repair the break, resulting in the introduction of the genetic material. To demonstrate this Cas9-mediated SDN-3 method, the PHP97131 (SEQ ID NO: 144), RC000019 (SEQ ID NO: 145), RC000020 (SEQ ID NO: 146), RC000021 (SEQ ID NO: 147), RC000022 (SEQ ID NO: 148), RC000023 (SEQ ID NO: 149), RC000024 (SEQ ID NO: 150) plasmids are used containing the following components: a haploid induction expression cassette having a polynucleotide encoding a full-length ZM-ODP2 protein (SEQ ID NO: 144) or a polynucleotide encoding a ZM-ODP2 protein variant ((SEQ ID NO: 145), (SEQ ID NO: 146), (SEQ ID NO: 147), (SEQ ID NO: 148), (SEQ ID NO: 149), or (SEQ ID NO: 150)) operably linked to the "PvEC1 promoter" (SEQ ID NO: 34); a SV40 NLS-Cas9-VIRD2 fusion protein operably linked to a ZM-EXP31554 promoter; gRNA expression cassettes operably linked to *Zea mays* RNA polymerase III promoter sequences required for creating double strand breaks at *Zea mays* chromosome 1 target sites; a DsRED fluorescent protein operably linked to a constitutive promoter; a maize-optimized Cre recombinase protein operably linked to the "PvEC1 promoter" (SEQ ID NO: 34); and a gene targeting donor template with a polynucleotide encoding the neomycin phosphotransferase II (nptII) selectable marker gene operably linked to a constitutive promoter (ZmUBI PRO) flanked by homology arms. LoxP sites flank the above expression cassettes to allow CRE-mediated excision of the intervening polynucleotide.

Plasmid PHP97131 provides Cas9 activity during haploid parthenogenesis to create a double strand break at the chromosome 1 target sites followed by homologous recombination of the ZmUBI PRO::NPTII:PIN II terminator via homology directed repair (HDR), thereby conferring kanamycin tolerance. DsRED expression, or absence thereof, per embryo per event is scored to evaluate Cre-mediated excision frequencies. Positive selection for kanamycin tolerance in vitro is performed to evaluate gene targeting frequencies. Previous results using plasmid PHP97131 indicated up to 1.4% of the plants had evidence for HDR-mediated repair for at least one of two flanking junction sites.

Improvements in HDR-mediated repair are expected using plasmids ((SEQ ID NO: 145), (SEQ ID NO: 146), (SEQ ID NO: 147), (SEQ ID NO: 148), (SEQ ID NO: 149), or (SEQ ID NO: 150)) containing ZM-ODP2 variants to confer improved haploid parthenogenesis in combination with the SDN3 genome modification components. Briefly, immature embryos of a maize $F_1$ hybrid resulting from the cross of two inbred parental lines are transformed using *Agrobacterium* strain LBA4404 THY- (see U.S. Pat. No. 8,334,429 incorporated herein by reference in its entirety). Transformation is performed using an *Agrobacterium* mixture, as previously described (see US Patent Publication No.

2021/0062203 incorporated herein by reference in its entirety). Transformation with an *Agrobacterium* strain containing the RV020636 plasmid (SEQ ID NO: 151) is used to obtain transgenic plants having a single-copy of an integrated T-DNA from a "trait" plasmid, wherein each plasmid comprises a ZM-ODP2 full length or variant (SEQ ID NO:1 (full length) and SEQ ID NO: 5-10 ZM-ODP2 variant) (see Table 16). Specifically, the transformation is performed with a mixture comprising 90% of the *Agrobacterium* strain having the "trait" plasmid ((SEQ ID NO: 144), (SEQ ID NO: 145), (SEQ ID NO: 146), (SEQ ID NO: 147), (SEQ ID NO: 148), (SEQ ID NO: 149), or (SEQ ID NO: 150)) and 10% of the RV020636 plasmid (SEQ ID NO: 151) (v/v).

TABLE 16

| Plasmid SEQ ID NO: | Plasmid | comprising ZM-ODP2 variant: | ZM-ODP2 SEQ ID NO: | Trait gene |
|---|---|---|---|---|
| 144 | PHP97131 | ZM-ODP2 | 1 | neomycin phosphotransferase II (nptII) |
| 145 | RC000019 | ZM-ODP2 (TR9) | 5 | |
| 146 | RC000020 | ZM-ODP2 (TR10) | 6 | |
| 147 | RC000021 | ZM-ODP2 (TR8) | 7 | |
| 148 | RC000022 | ZM-ODP2 (TR12)-linker-ZM-ODP2 (TR5)-V2 | 8 | |
| 149 | RC000023 | ZM-ODP2 (TR11)-linker-ZM-ODP2 (TR5)-V2 | 9 | |
| 150 | RC000024 | ZM-ODP2 (TR11)-linker-ZM-ODP2 (TR12)-linker-ZM-ODP2 (TR5) | 10 | |

It is expected that few, if any, plants will have a T-DNA from the RV020636 plasmid. Plants with a single copy of a T-DNA from a "trait" plasmid (see Table 16) which confers simultaneous haploid induction, genome modification, and Cre-mediated excision capabilities are grown to maturity.

The $F_1/T_0$ plants used as ear donors (female parent) are fertilized with pollen from a maize inbred that is a non-haploid inducer line containing a CFP color marker. Approximately 14-18 days after fertilization, donor ears containing immature embryos are harvested and immature embryos are collected. Embryos scored as CFP-negative are interpreted as maternal haploid embryos given the absence of the paternal CFP color marker. CFP-negative embryos that are also DsRED-negative, interpreted as having egg cell expression of the genome-modification expression cassettes are selected, cultured, and regenerated plantlets are transplanted to soil.

Leaf material is sampled and DNA is isolated and used in molecular analysis methods. Diagnostic assays to PCR amplify across the junction sites to measure HDR-mediated gene insertion of the donor template is performed.

It is expected that HDR-mediated repair is improved using ZM-ODP2 variants expressed in combination with the SDN3 genome modification components in comparison to HDR-mediated repair resulting from full length ZM-ODP2 expressed in combination with the SDN3 genome modification components.

Example 9: Improved Method Using ZM-ODP2 Variants and Genetic Chromosome Doubling for Obtaining Maternal Di-Haploids In Vivo It is expected that the level of simultaneous haploid parthenogenesis and genetic chromosome doubling achieved by providing to an egg cell the combined activity of the ZM-ODP2-(266-669) variant, lacking a stop codon, and a cyclin gene, dpzm07g031470.1.1, herein called Dz470 (SEQ ID NO: 110) encoding a cyclin delta-2-like protein (SEQ ID NO: 111), using plasmid RV035609 (SEQ ID NO: 112) is further improved.

The benefits of the simultaneous activity of the haploid induction characteristic of a haploid inducer line combined with genetic chromosome doubling activity are numerous. These benefits include, but are not limited to, the elimination of 1) performing haploid induction crosses that require planting both a donor plant and a haploid inducer plant, 2) monitoring embryo development after performing the haploid induction cross, 3) harvesting the donor ear of said haploid induction cross in a timely manner based on embryo development, 4) isolating embryos from said donor ear (often a labor-intensive and tedious process), 5) contacting isolated embryos with a chemical chromosome doubling agent (a process that can pose safety and health concerns of exposure to mammalian cells), 6) removing treated embryos from contact with said chemical chromosome doubling agent, 7) identifying and sorting haploid from diploid embryos, 8) transferring selected haploid embryos for continued in vitro tissue culture propagation, 9) regenerating a plantlet from said tissue culture steps, 10) hardening the plantlet, 11) transplanting said hardened plantlet, and 12) the negative impacts that can occur at each step that can result in impaired development, and more importantly impaired fertility, of said doubled haploid plant. The methods disclosed herein positively impact logistics resulting in cost savings and provide productivity gains for breeding programs using doubled haploid technologies through reduced attrition of haploid embryos throughout the process. Thus, the methods disclosed herein provide doubled haploid plants with relatively less logistical support, at reduced cost, and with reduced attrition.

A. Improving Productivity for Methods of Obtaining In Vivo Diploidized Maternal Di-Haploids Using Dz470

As described in Examples 3 and 4, $F_1$ embryos derived from a breeding cross, such as a biparental cross, are obtained and transformed with an experimental control plasmid RV035609 (SEQ ID NO: 112, see Table 2). The RV035609 plasmid contains a polycistronic expression cassette. Experimental plasmids (RX000001, RX000002, RX000003, RX000004, RX000005, and RX000006) used in the methods disclosed herein are shown in Table 17. Each plasmid comprises a polycistronic expression cassette encoding an alternative ZM-ODP2 peptide, wherein each ZM-ODP2 peptide was shown to confer improved haploid parthenogenesis as demonstrated in Example 4.

TABLE 17

| Plasmid | DNA SEQ ID NO: | Expression Cassette Name | DNA Polynucleotide Name |
|---|---|---|---|
| RX000001 | 113 | ZM-ODP2 variant 3: Dz470 | ZM-ODP2 (TR9):T2A: DZ470::PINII TERM |
| RX000002 | 114 | ZM-ODP2 variant 4: Dz470 | ZM-ODP2 (TR10):T2A: DZ470::PINII TERM |
| RX000003 | 115 | ZM-ODP2 variant 5: Dz470 | ZM-ODP2 (TR8):T2A: DZ470::PINII TERM |

TABLE 17-continued

| Plasmid | DNA SEQ ID NO: | Expression Cassette Name | DNA Polynucleotide Name |
|---|---|---|---|
| RX000004 | 116 | ZM-ODP2 variant 6: Dz470 | ZM-ODP2 (TR12):linker:ZM-ODP2 (TR5)-V2:T2A: DZ470::PINII TERM |
| RX000005 | 117 | ZM-ODP2 variant 7: Dz470 | ZM-ODP2 (TR11):linker:ZM-ODP2 (TR5)-V2:T2A: DZ470::PINII TERM |
| RX000006 | 118 | ZM-ODP2 variant 8: Dz470 | ZM-ODP2 (TR11):linker:ZM-ODP2 (TR12):linker:ZM-ODP2 (TR5):T2A: DZ470::PINII TERM |

When a non-haploid inducer line was used as the pollen donor, maternal haploid induction levels observed in $T_0$ events transformed with plasmid RV035609 (SEQ ID NO: 112) exhibited an 18.2% maternal haploid induction frequency and within that sample of maternal haploid embryos it was observed that 18% of those embryos also exhibited in vivo chromosome doubling.

It is expected that simultaneous haploid parthenogenesis and in vivo chromosome doubling frequencies are improved by providing to a plant cell pollen from a haploid inducer line expressing the activity of a ZM-ODP2 variant peptide and a cyclin Dz470 peptide to provide an in vivo diploidized (2n) embryo containing only maternal chromosomes. For example, a haploid induction cross wherein the silk of the $T_0$ ears are pollinated with pollen grains from any haploid inducer plants, such as Stock 6, RWK, RWS, UH400, AX5707RS, and NP2222-matl, or any haploid inducer line it is expected that the plasmids shown in Table 17 will improve the productivity and frequency of obtaining a diploidized (2n) embryo containing only maternal chromosomes in comparison to results demonstrated using plasmid RV035609 (SEQ ID NO: 112).

B. Improving Productivity of Obtaining In Vivo Diploidized Maternal Di-Haploids Using Cyclin D Family Member Proteins It is expected that cyclin protein family members are useful as an alternative to the Dz470 protein for genetic chromosome doubling in the methods disclosed herein for obtaining maternal embryos that have been diploidized in vivo in response to the simultaneous activity of the ZM-ODP2 peptide and the Dz470 peptide. The cyclin protein family members useful in the methods disclosed herein are those cyclins capable of linking growth and cell cycle control, such as a D-type cyclin. For example, D-type cyclins that are family members having homology to Dz470, a cyclin delta-2 protein. It is expected that plasmids similar to those shown in Table 17 in which a cyclin family member shown in Table 18 replaces Dz470 providing the simultaneous activity of the ZM-ODP2 peptide and a cyclin gene family member used in the methods disclosed herein will provide maternal embryos that have been diploidized in vivo.

In addition, it is expected that the genetic chromosome doubling methods disclosed herein in which a cyclin gene, such as Dz470, or alternatively a cyclin gene family member, or preferentially a combination thereof, increase the frequency of maternal di-haploid embryos produced from a haploid induction cross using any haploid inducer line. It is expected the in vivo genetic chromosome doubling methods disclosed herein using alternative cyclins increases the frequency of di-haploids in transgenic $T_1$ plants compared to non-transgenic plants.

TABLE 18

| Homolog ID | Organism | Relation | Hit Description | DNA SEQ ID NO: | PRT SEQ ID NO: |
|---|---|---|---|---|---|
| At2g22490.1 | *Arabidopsis thaliana* | ortholog | CYCD2; 1 | 556 | 574 |
| At5g65420.1 | *Arabidopsis thaliana* | family | CYCD4; 1 | 557 | 575 |
| At5g10440.1 | *Arabidopsis thaliana* | family | CYCD4; 2 | 558 | 576 |
| Glyma14g35850.1 | *Glycine max* | ortholog | D-type cyclin | 559 | 577 |
| Glyma02g37560.1 | *Glycine max* | family | Cyclin | 560 | 578 |
| Glyma01g03030.1 | *Glycine max* | family | Cyclin | 561 | 579 |
| Glyma18g21730.1 | *Glycine max* | family | Cyclin | 562 | 580 |
| Os09g29100.1 | *Oryza sativa* | candidate | cDNA putative, expressed | 563 | 581 |
| Os08g37390.1 | *Oryza sativa* | family | cDNA putative, expressed | 564 | 582 |
| Os07g42860.1 | *Oryza sativa* | family | cDNA putative, expressed | 565 | 583 |
| Sb02g027020.1 | *Sorghum bicolor* | ortholog | D-type cyclin | 566 | 584 |
| Sb07g023350.1 | *Sorghum bicolor* | family | D-type cyclin | 567 | 585 |
| Sb02g039550.1 | *Sorghum bicolor* | family | D-type cyclin | 568 | 586 |
| dpzm04g027750.1.1 | *Zea mays* | family | Cyclin delta-2 | 569 | 587 |
| dpzm04g051480.1.1 | *Zea mays* | family | Cyclin, C-terminal domain protein | 570 | 588 |
| dpzm05g068750.1.1 | *Zea mays* | family | Cyclin, C-terminal domain protein | 571 | 589 |
| dpzm01g064180.1.1 | *Zea mays* | family | D-type cyclin | 572 | 590 |
| dpzm02g059300.1.1 | *Zea mays* | family | Cyclin | 573 | 591 |

C. Obtaining a Doubled Haploid Plant Using In Vitro Tissue Culture

T-DNA plasmid elements useful in the methods disclosed herein are excised to provide a plant having normal diploid seed in subsequent generations. For example, the T-DNA conferring the genetic chromosome doubling trait is excised in a tissue-preferred manner, preferentially in a tissue-specific manner, and more preferentially in a tissue-specific manner after genetic chromosome doubling activity has been provided to a plant cell thereby eliminating the need for chemical chromosome doubling. A first plasmid used as a control, herein called plasmid "Dz470control" (SEQ ID NO: 152) contains the following feature elements: PV-EGG CELL PRO (TR1)::PINII TERM and a second plasmid, herein called plasmid "Dz470experimental" (SEQ ID NO: 153) contains an expression cassette with the following feature elements: PV-EGG CELL PRO (TR1)::ZM-CYCD2::PINII TERM, respectively, are transformed into any inbred or hybrid of interest. Transgenic $T_0$ plants containing the desired expression cassette are regenerated and screened by qPCR assays to identify single copy, hemizygous individual plants for each plasmid. Selected plants are grown and are used as silk donors in haploid induction crosses.

The transgenic ear donor has three expression cassettes conferring 1) haploid induction 2) genetic chromosome doubling and 3) CRE-mediated excision using loxP sites flanking all three expression cassettes. The ears of the transgenic $T_0$ plants are shoot-bagged before silk emergence to avoid any foreign pollen contamination. The silk of the $T_0$ ears is pollinated with pollen grains from a haploid inducer plant, such as Stock 6, RWK, RWS, UH400, AX5707RS, and NP2222-matl, or any haploid inducer line. Immature ears are harvested at approximately 3-24 days after pollination, ideally at approximately 15 days. The ears are surface sterilized in 30% bleach plus 0.5% Micro detergent for 20 minutes and rinsed three times with sterile water.

All embryos are isolated and haploid embryos are identified based on the absence of expression of anthocyanin from the paternal inducer line. In vivo diploidized embryos are identified and separated from haploid embryos, for example, by using flow cytometry ploidy analysis methods. The di-haploid maternal embryos are genotyped and selected, for example, by using predictive selection algorithms based on genetic marker data to estimate the genomic estimated breeding value. It is expected that such methods for predictive selection can improve the efficiency of a breeding program by reducing the need to phenotype undesirable genotypes. Population-based selections are made prior to transplanting the sampled plantlet to soil, thus, reducing the cost of generating a breeding population.

The haploid maize embryos are placed on a plant regeneration medium in a light culture room. Approximately 12-18 days later, plantlets are transferred to flats containing potting soil and grown for 2 weeks in the greenhouse, then transferred to pots and grown to maturity. These plants are self-pollinated to produce $T_2$ seeds.

D. Obtaining a Maternal Di-Haploid Embryo from a Mature Seed

The methods disclosed herein provide efficiencies in generating and identifying a mature seed resulting from a haploid induction cross. It is expected that the maternal embryos generated are in vivo diploidized (2n) embryos that subsequently produce progeny having normal modes of sexual reproduction. In another aspect, the methods disclosed herein are performed as described above, wherein the donor plant having the donor ear fertilized with pollen from a haploid inducer line is grown to maturity to obtain seed. No embryo rescue steps or the subsequent tissue culture processes described above are needed to recover the mature seed.

Embryos are obtained by paternal genome elimination as described in Example 4. An expression cassette comprising a polynucleotide encoding a cyclin gene, a reporter gene, and a gene product useful for site-directed recombination technology is used. For example, a heterologous polynucleotide encoding the Dz470 gene, a fluorescent protein, and a recombinase useful for excision, wherein the DNA sequences encoding these components is flanked with DNA sequences encoding recognition sites for the site-specific recombinase. A fluorescent protein (reporter gene) operably linked to a regulatory element conferring constitutive expression, or preferentially operably linked to a regulatory element conferring seed-preferred expression, or more preferentially, operably linked to a regulatory element conferring embryo-preferred expression is used. It is expected that a seed comprising a maternally derived, di-haploid embryo with an excised T-DNA that lacks the reporter gene (fluorescent protein) activity and the reporter gene activity provided from the haploid inducer pollen donor is identified.

Example 10: Method to Obtain Maternal Haploids Using Targeted Parthenogenesis Factor Modulation in a Plant Cell Using Deactivated Cas Proteins This Example 10 describes methods for targeted parthenogenesis factor regulation using a translational fusion protein comprising a Cas endonuclease. Specifically, RNA-guided CRISPR-Cas systems are used to hybridize to DNA encoding a target sequence, whereby expression of at least one gene product is altered. Target sequences useful in the methods disclosed herein include, but are not limited to, morphological developmental genes and/or parthenogenesis factors such as those described in Example 6. The RNA-guided CRISPR-Cas systems include designs for heterologous proteins comprising a degenerate, also known as deactivated, Cas protein (dCas) used as a recognition domain that is fused to a regulatory domain, such as a transcriptional activator domain, a transcriptional repressor domain, and/or a chromatin modification domain useful for altering expression at the target site.

A. ZM-ODP2 Activation in a Plant Cell Using Deactivated Cas Proteins

Recruitment of a dCas9-fusion protein to the endogenous locus encoding at least one AP2-containing transcription factor, and preferentially a ZM-ODP2 gene, is achieved using guide RNAs (gRNAs). Once the ribonucleotide complex is recruited to the target locus, haploid parthenogenesis is achieved by altering expression of at least one gene product, including, but not limited to, post-translational modifications of histone modifications, including, but not limited to, (a) removing histone modifications associated with repressing gene expression, (b) establishing histone modifications associated with promoting gene expression, and/or (c) recruiting transcriptional machinery associated with expressing a gene. The methods of the present disclosure provide improvements in maize maternal doubled haploid technologies by providing one of the above-mentioned activities to an egg cell to activate parthenogenesis.

Heterologous proteins comprising dCas9 translational fusion proteins containing chromatin modification domains, including a histone demethylase domain, particularly the Jumanji (JMJ) family of lysine demethylases conferring histone demethylase catalytic activity, herein referred to as a dCAS9-JMJ fusion protein, are useful in the methods disclosed herein. Heterologous proteins comprising a deactivated Cas9 (dCas9) protein fused to the histone acetyltransferase (HAT) domain, including, but not limited to, domains characterized as a General Control Nonrepressed (Gcn5)-related N-acetyltransferases (GNAT) domain, a MYST domain, and/or a type B catalytic subunit domain, each of which confer histone acetyltransferase catalytic activity, herein referred to as a dCas9-HAT fusion protein are also useful in the methods disclosed herein. Exemplary sequences of chromatin regulatory domains useful for dCas translational fusion proteins are shown in Table 19.

TABLE 19

| Domain Name | Domain Feature | DNA SEQ ID NO: | Peptide SEQ ID NO: |
|---|---|---|---|
| CBF1a | C-repeat Binding Factor transcriptional activator | 443 | 449 |
| GNAT1 | General Control Non-repressed (Gcn5)-related N-acetyltransferases (GNAT) domain 1 | 444 | 450 |
| GNAT2 | General Control Non-repressed (Gcn5)-related N-acetyltransferases (GNAT) domain 2 | 445 | 451 |
| HAT1 | MOZ, Ybf2/Sas3, Sas2 and Tip60 proteins (MYST) domain | 446 | 452 |
| HAT2 | type B catalytic subunit (HAG2) domain | 447 | 453 |
| JMJ | Jumonji histone demethylase domain | 448 | 454 |

dCas9 expression cassettes useful in the methods disclosed herein for activating parthenogenic maternal haploid induction containing the chromatin modification domains shown in Table 19 operably linked to the PvEC1 promoter are shown in Table 20.

TABLE 20

| Expression Cassette | DNA SEQ ID NO: | Peptide SEQ ID NO: |
|---|---|---|
| PvEC1 PRO::dCas9-CBF1a | 455 | 461 |
| PvEC1 PRO::dCas9-GNAT1 | 456 | 462 |
| PvEC1 PRO::dCas9-GNAT2 | 457 | 453 |
| PvEC1 PRO::dCas9-HAT1 | 458 | 464 |
| PvEC1 PRO::dCas9-HAT2 | 459 | 465 |
| PvEC1 PRO::dCas9-JMJ | 460 | 466 |

Preferentially, heterologous proteins comprising dCas-alpha (dCasα) translational fusion proteins are used, for example, where the Cas endonucleases are Cas alpha endonucleases as shown in Table 21.

TABLE 21

| Name | Organism | Cas alpha (Casa) SEQ ID NO: DNA | Protein | Class |
|---|---|---|---|---|
| Casα1 | *Candidatus Micrarchaeota archaeon* | 467 | 478 | Class 2 CRISPR-Cas system |
| Casα2 | *Candidatus Micrarchaeota archaeon* | 468 | 479 | Class 2 CRISPR-Cas system |
| Casα3 | *Candidatus Aureabacteria bacterium* | 469 | 480 | Class 2 CRISPR-Cas system |
| Casα4 | Uncultured bacterium | 470 | 481 | Class 2 CRISPR-Cas system |
| Casα5 | *Candidatus Micrarchaeota archaeon* | 471 | 482 | Cas-alpha protein |
| Casα6 | Uncultured bacterium | 472 | 483 | Cas-alpha protein |
| Casα7 | *Parageobacillus thermoglucosidasius* | 473 | 484 | Cas-alpha protein |
| Casα8 | *Acidibacillus sulfuroxidans* | 474 | 485 | Cas-alpha protein |
| Casα9 | *Ruminococcus* sp | 475 | 486 | Cas-alpha protein |
| Casα10 | *Syntrophomonas palmitatica* | 576 | 487 | Cas-alpha protein |
| Casα11 | *Clostridium novyi* | 477 | 488 | Cas-alpha protein |

The Cas endonucleases shown in Table 21 may comprise a modified form of the Cas protein. The modified form of the Cas protein includes an amino acid change (e.g., deletion, insertion, or substitution) that reduces the naturally-occurring nuclease activity of the Cas protein. For example, in some instances, a modified form of the Cas protein has less than 50%, less than 40%, less than 30%, less than 20%, less than 10%, less than 5%, or less than 1% of the nuclease activity of the corresponding wild-type Cas polypeptide. In some cases, the modified form of the Cas protein has no substantial nuclease activity and is referred to as catalytically "inactivated Cas" or "degenerate Cas" or "deactivated Cas (dCas)". An "inactivated" ~Cas, or "degenerate" or "deactivated" Cas, includes a deactivated Cas endonuclease (dCas). A deactivated Cas endonuclease (dCas) may be used in the methods disclosed herein with a guide RNA to target a specific DNA target site.

A catalytically inactive Cas effector protein is fused to a heterologous sequence comprising a regulatory domain resulting in a translational fusion protein that facilitates cellular reprogramming for use in haploid parthogenesis induction. For example, fusion proteins useful in cellular reprogramming include, but are not limited to, fusion proteins comprising a gene activation domain and/or a chromatin modifying domain as shown in Table 19, wherein the regulatory domain provides the capability to induce or modify (modulate) gene regulation and/or to induce or modify (modulate) gene chromatin remodeling activity at a genomic target site.

It is expected that haploid parthenogenesis is improved by providing to an unfertilized egg cell a dCas ribonucleotide complex containing a gRNA that targets ZM-ODP2.

Parthenogenesis is achieved by altering (modulating) expression of ZM-ODP2, including, but not limited to, post-translational modifications of histone modifications, including, but not limited to, (a) removing histone modifications associated with repressing gene expression, (b) establishing histone modifications associated with promoting gene expression, and/or (c) recruiting transcriptional machinery associated with expressing a gene. The methods of the present disclosure provide improvements in maize maternal doubled haploid technologies by providing one of the above-mentioned activities to an egg cell to activate haploid parthenogenesis.

B. Parthenogenesis Factor Repression in a Plant Cell Using Deactivated Cas Alpha Proteins Methods to overcome a plant cell's repression of haploid parthenogenesis are disclosed herein. One such method for increasing haploid parthenogenesis is achieved by inhibiting repressors of ZM-ODP2 protein activity, such as the parthenogenesis factors shown in Examples 6 and 7. Genetic loci encoding proteins acting to inhibit ZM-ODP2 protein activity are useful as genomic target sites in the methods disclosed herein.

Methods for targeted gene repression using a translational fusion protein comprising a Cas endonuclease are useful in the methods disclosed herein. Preferentially, a translational fusion protein having a catalytically inactive Cas alpha peptide, such as a peptide shown in Table 21, fused to a heterologous sequence comprising a regulatory domain, wherein the fusion protein represses a gene at a genomic target site encoding gene products that inhibit ZM-ODP2 protein activity id used. Repressor domains useful in the methods disclosed herein are shown in Table 22.

TABLE 22

| Repressor Domain | Organism | DNA SEQ ID NO: | PRT SEQ ID NO: |
|---|---|---|---|
| ERFmotif.1 | *Zea mays* | 506 | 523 |
| ERFmotif.2 | *Zea mays* | 507 | 524 |
| AP2/ERFrepressormotif1 | *Zea mays* | 508 | 525 |
| AP2/ERFrepressormotif2 | *Zea mays* | 509 | 526 |
| TLLLFR.motif | *Zea mays* | 510 | 527 |
| Dr1 | *Zea mays* | 511 | 528 |
| ZincFinger(DLN-like) | *Zea mays* | 512 | 529 |
| B3motif | *Zea mays* | 513 | 530 |
| RLFGV-like-1 | *Zea mays* | 514 | 531 |
| RLFGV-like-2 | *Zea mays* | 515 | 532 |
| RLFGV-like-3 | *Zea mays* | 516 | 533 |
| RLFGV-like-4 | *Zea mays* | 517 | 534 |
| *Triticum aestivum* repressor | *Triticum aestivum* | 518 | 535 |
| Dr1-associated corepressor-like 1 | *Zea mays* | 519 | 536 |
| Dr1-associated corepressor-like 3 | *Zea mays* | 520 | 537 |
| WUSCHEL Box | *Zea mays* | 521 | 538 |
| WUSCHEL Box domain | *Zea mays* | 522 | 539 |

Expression cassettes, for improving maternal haploid induction, containing a polynucleotide encoding a dCas-alpha translational fusion protein operably linked to an egg cell expressing promoter to activate haploid parthenogenesis are disclosed herein. Plasmids useful for inducing haploid parthenogenesis comprising a polynucleotide sequence encoding a dCas-alpha repressor translational fusion protein are constructed. Examples of such useful plasmids include, but not limited to, plasmids are described in Example 4, wherein the polynucleotide encodes a ZM-ODP2 protein. An exemplary expression cassette containing a polynucleotide encoding a dCas-alpha repressor translational fusion protein is provided, comprising a deactivated putative Class II CRISPR/Cas endonuclease having a D228A mutation introduced to eliminate cleavage activity, the stop codon is removed for C-terminus nuclear localization signal and is fused to the *Zea mays* Dr1-associated corepressor-like 1 sequence (SEQ ID NO: 550). Haploid parthenogenesis is evaluated as described in Example 4.

Other repressors are useful in the methods discloses herein. Such a fusion protein is designed to encode for two or more such repressor domains. Fusion proteins containing different Cas peptides, preferentially any alternative Cas-alpha peptide shown in Table 22 are useful in the methods disclosed herein. gRNA molecules designed to recruit the fusion proteins to a genomic target site encoding gene products acting to inhibit ZM-ODP2 protein activity are used in the methods disclosed herein. It is expected that increased haploid parthenogenesis occurs using the methods disclosed herein. For example, it is expected that a fusion protein containing a the *Zea mays* Dr1-associated corepressor-like 1 sequence is a repressor interacts with the TATA-binding protein (TBP) of transcription Factor II D (TFIID) complex to prevent the formation of an active transcription complex by precluding the entry of transcription Factor II A (TFIIA) and/or transcription Factor II B (TFIIB) into the preinitiation complex. gRNAa having homology to at least one genomic target site for at least one parthenogenesis factor as described in Example 6 and/or Example 7 are useful in the methods disclosed herein.

C. Improved Haploid Parthenogenesis Using Combined Parthenogenesis Factor Repression in a Plant Cell Using Combined Deactivated Cas Proteins It is expected that improved haploid parthenogenesis is achieved using methods comprising simultaneous activation of a genomic target site encoding a ZM-ODP2 peptide and repression of at least one genomic target site encoding a gene product acting to inhibit ZM-ODP2 protein activity.

A multitude of Cas peptides are provided above, each with PAM sites that differ, thereby enabling methods wherein two or more deactivated Cas proteins provided to a cell are recruited in a homology-dependent manner using gRNAs engineered for that purpose. The DNA sequences at desired target sites are designed using PAM sites corresponding to the desired dCas recognition domains of each fusion protein and its desired gene regulatory action. By combining two more dCas fusion protein activities in one cell activation of a genomic target site encoding a Zm-ODP2 gene product is achieved while a genomic target site encoding a repressor of Zm-ODP2 protein activity, such as the parthenogenesis factors shown in Example 7 is repressed.

Double fertilization is not required for development of a parthenogenic maternal haploid embryo, yet single fertilization is required for proper endosperm development. Pseudogamy methods of maternal haploid induction requiring pollination that does not involve male inheritance (FIG. 2) are disclosed herein. The parthenogenic haploid embryos are detected using the methods described in Example 4.

It is expected such combined activity improves haploid parthenogenesis when such combined dCas fusion protein activities described herein are provided to a plant cell, particularly a female gametophyte, such as an egg cell, in comparison to results obtained using the methods disclosed in section A alone or section B alone described above in this Example 10.

D. Improved Haploid Parthenogenesis Using a Mutated Repressor of Zm-ODP2 Protein Activity Simultaneous activation of a genomic target site encoding a ZM-ODP2 peptide and repression of at least one genomic target site encoding a gene product acting to inhibit ZM-ODP2 protein activity is provided to a maternal cell having a mutation in at least one locus encoding a gene product that can inhibit haploid parthenogenesis. As described above, double fertilization is not required for development of a parthenogenic maternal haploid embryo, yet single fertilization is required for proper endosperm development. Pseudogamy methods of maternal haploid induction requiring pollination that does not involve male inheritance (FIG. 2) are disclosed herein.

A variety of methods are available to obtain a plant having a mutation in a gene. Preferentially, the method uses a programmable nuclease to confer a target site specific mutation, for example using a CRISPR-Cas nuclease. More preferentially, the methods disclosed herein use a functionally active Cas nuclease, for example a Cas-alpha shown in Table 22, wherein the Cas-alpha protein is recruited to a genomic target site encoding a gene product that inhibits haploid parthenogenesis. A Cas endonuclease is used with a guide RNA to target a specific DNA target site making it possible obtain a plant having a mutation in a gene that inhibits haploid parthenogenesis before, during, or after providing ZM-ODP2 protein activity to a maternal cell, such as an egg cell.

It is expected the methods disclosed herein provide improved haploid parthenogenesis when such cell having a mutation is provided ZM-ODP2 protein activity in comparison to a cell lacking such a mutation. Further, it is expected the methods disclosed herein improve haploid parthenogenesis in a broader range of genetic backgrounds. For example, it was shown in Example 4 that haploid parthenogenesis varied between a first and a second breeding cross even though the same plasmid (genetic construct) was used in the transformations. These phenotypic variations may be due to variable levels of such repressors inhibiting ZM-ODP2 protein activity. It is expected that a genotype exhibiting a lower level of haploid induction has correspondingly higher activities of at least one such repressor protein that inhibits haploid parthenogenesis. Thus, it is expected that haploid parthenogenesis is improved using the methods disclosed herein, particularly when applied to genetic backgrounds exhibiting lower levels of haploid parthenogenesis.

Example 11: Methods for Obtaining Maternal Haploids Using Haploid Induction Crosses that Modulate Haploid Parthenogenesis Methods for modulating parthenogenesis factor activity using a translational fusion protein comprising a Cas endonuclease, in which the modulating effects of the parthenogenesis factor activity are provided to a maternal cell, particularly a female gametophyte, such as an egg cell, by the paternal genome, particularly a male gametophyte, such as a pollen cell are disclosed herein. More particularly, the paternal genome is a haploid inducer line, such as Stock 6, RWK, RWS, UH400, AX5707RS, and NP2222-matl, or any haploid inducer line that is transformed using the methods described in Example 3. The transformed haploid inducer line is used for pollen-mediated delivery of at least one protein acting to modulate gene regulation in a maternal cell.

Methods of modulating haploid parthenogenesis in a maternal cell comprise using RNA-guided CRISPR-Cas systems provided by the paternal chromatin to hybridize to DNA encoding a target sequence on either the maternal or paternal chromatin, whereby expression of at least one gene product is altered when the sperm cell nucleus is provided to the egg cell upon fertilization. The pollen-mediated delivery of at least one protein acting to modulate gene regulation in a maternal cell is achieved using a regulatory element that is active in the male gametophyte, such as a regulatory element conferring pollen expression that provides an expressed protein to the egg cell upon fertilization or an embryonic regulatory element that provides an expressed protein after the egg and pollen cells fuse (syngamy) yet before paternal genome elimination occurs. Exemplary sequences include, but are not limited to, regulatory elements shown in Table 23.

TABLE 23

| SEQ ID NO: | DNA Regulatory Element Name | Locus Description | Organism | Regulatory Element Activity |
|---|---|---|---|---|
| 489 | ZM-PRF2 PRO | Profilin homolog 2 (dpzm08g059270.1.1) | *Zea mays* | Pollen |
| 490 | ZM-PRF2 5UTR | Profilin homolog 2 (dpzm08g059270.1.1) | | |
| 491 | ZM-SF3 PRO | Pollen-specific protein SF3-like protein (dpzm02g013460.1.1) | | |
| 492 | ZM-SF3 5UTR | Pollen-specific protein SF3-like protein (dpzm02g013460.1.1) | | |
| 493 | ZM-PLAA PRO (TR1) | pectate lyase (dpzm04g070630.1.1) | | |
| 494 | ZM-PLAA 5UTR | pectate lyase (dpzm04g070630.1.1) | | |
| 495 | ZM-BBM2 PRO | Maize BABY BOOM 2, (dpzm05g057430) | *Zea mays* | Embryonic |
| 496 | ZM-BBM2 5UTR | Maize BABY BOOM 2, (dpzm05g057430) | | |
| 497 | OS-BBM1 PRO (3KB) | Baby Boom 1 (Os11g19060) | *Oryza sativa* | |

The methods disclosed herein can use any of the above regulatory elements, or any additional regulatory elements, no effort is made herein to describe all possible permutations or combinations thereof. It is also understood that different expression cassettes using different regulatory elements vary the duration, strength, and spatiotemporal control of gene expression conferred by any given regulatory element. Such outcomes are useful for modulating haploid parthenogenesis.

Methods of modulating parthenogenesis factor activity in a maternal cell use a translational fusion protein, preferentially containing a Cas endonuclease. Particularly, constructs comprising a first expression cassette encoding a first translational fusion protein capable of targeting one or more genomic target sites for up-regulation (increased gene activity) and a second expression cassette encoding a second translational fusion protein capable of targeting one or more genomic target sites for down-regulation (decreased gene activity) are useful in the methods disclosed herein. It is expected that each respective translational fusion protein will recognize a mutually exclusive protospacer adjacent motif (PAM) sequence. A PAM herein refers to a short nucleotide sequence adjacent to a target sequence (protospacer) that is recognized (targeted) by a guide polynucleotide/Cas endonuclease system. Thus, precise targeting of each respective translational fusion protein is achieved by the gRNA design, the PAM sequence at the genomic site of interest, and the PAM recognition requirements for the various Cas nucleases.

Translational fusion proteins containing a recognition domain having a degenerate, also known as deactivated Cas protein (dCas) that does not cleave a target site to which it is guided are useful in the methods disclosed herein. Cas nucleases useful in the methods disclosed herein are shown in Table 21. It is expected the dCas recognition domain forms a functional complex with a guide RNA that shares homology with a DNA sequence at the genomic target site. The dCas translational fusion that forms a functional complex with a guide polynucleotide that is recruited and binds to a target site affects the gene regulation state of the locus encoded at the genomic target site, which depends on the regulatory activity of the regulatory domain for each respective fusion protein.

Regulatory domains useful in the methods disclosed herein include, but are not limited, to peptides encoding a transcriptional activator domain, a transcriptional repressor domain, and/or a chromatin modification domain useful for altering expression at the target site. Exemplary domains useful for conferring increased gene activity are shown in Table 19. Exemplary domains useful for conferring decreased gene activity are shown in Table 22.

Plasmids are constructed having a polynucleotide containing a first expression cassette encoding a first translational fusion protein capable of targeting one or more genomic target sites for up-regulation (increased gene activity) and a second expression cassette encoding a second translational fusion protein capable of targeting one or more genomic target sites for down-regulation (decreased gene activity). Translational fusion proteins contain a recognition domain, for example a deactivated Cas alpha protein (dCasα) using a Cas peptide shown in Table 21, fused to a gene activation domain, for example such as those shown in Table 19, or fused to a gene repression domain, for example such as those shown in Table 22. Each expression cassette is operably linked to regulatory element that is expected to affect maternal haploid parthenogenesis, for example using a promoter such as those shown in Table 23. No effort is made herein to describe all possible combinations of such expression cassettes. It is expected the combined activity of these two expression cassettes simultaneously achieves altered gene expression in a plant cell, preferentially a female gamete cell, such as an egg cell. Particularly, such altered gene expression within an egg cell targets one group of loci to be up-regulated and a second group of loci to be down-regulated, thereby resulting in improved haploid parthenogenesis.

Exemplary genomic loci encoding gene products useful for targeted up-regulation comprise loci encoding morphological developmental genes and embryogenesis factors. For example, a morphogenic gene encoding a WUS/WOX homeobox polypeptide, or a Babyboom (BBM) polypeptide or an Ovule Development Protein 2 (ODP2) polypeptide, or a combination of thereof. In an aspect, the morphogenic gene encoding the WUS/WOX homeobox polypeptide is a WUS1, WUS2, WUS3, WOX2A, WOX4, WOX5, and WOX9 protein. In another aspect, the morphogenic gene encoding the Babyboom (BBM) polypeptide or the Ovule Development Protein 2 (ODP2) polypeptide is a Babyboom (BBM1), BBM2, BMN2, and BMN3 or the Ovule Development Protein 2 (ODP2) polypeptide.

Additional loci encoding other morphogenic genes useful for up-regulation in a female gamete, such as an egg cell, include, but are not limited to, LEC1, LEC2, KN1/STM, a homolog of MONOPTEROS-DELTA, a homolog of the *Arabidopsis* SERK gene, a homolog of the *Arabidopsis* AGL15 gene, or a homolog of the FUSCA gene. Exemplary genomic loci encoding gene products useful for targeted gene repression comprise loci encoding repressors of morphological developmental genes. For example, repression target sites that are components of stem cell signaling pathways, such as CLV3, and the species-specific proteins thereof, a C2H2-type zinc finger protein repressing WUSCHEL, such as a KNUCKLES repressor protein, and a MADS-box transcription factor, such as AGAMOUS or a species-specific AGAMOUS-like ortholog are useful in the methods disclosed herein. Repression target sites include, but are not limited to, a genomic locus encoding a polycomb-group (PcG) protein, or subunit thereof, acting to repress expression of a genomic locus encoding a morphological developmental gene and/or an embryogenesis factor. Repression target sites that are members of the E(z) (Enhancer of Zeste) family, such as EZH1 and EZH2, of the Polycomb Repressive Complex 2 (PRC2), or any protein possessing histone methyltransferase activity with specificity for Lys 9 (K9) and Lys 27 (K27) of histone H3 (herein referred to as "H3K37me3") are also useful in the methods disclosed herein.

Additional repression target sites useful in the methods disclosed herein include, but are not limited to, a genomic locus encoding a CHD3 chromatin-remodeling factor, or subunit thereof, acting to repress expression of a genomic locus encoding a morphological developmental gene and/or an embryogenesis factor, including, but not limited to a homolog of the PICKLE gene.

Given the results of Example 7, wherein haploid parthenogenesis observed in response to the co-expression of a ZM-ODP2 variant 8 peptide and a parthenogenesis factor peptide were decreased in comparison to the activity of the ZM-ODP2 variant 8 peptide variant alone, it is also expected the combined up-regulation of a morphogenic gene encoding the Babyboom (BBM) polypeptide or the Ovule Development Protein 2 (ODP2) combined with repression of a gene encoding a parthenogenesis factor is useful in the methods disclosed herein. For example, repression of a gene shown in Table 13.

Plasmids having a polynucleotide containing a first expression cassette encoding a first translational fusion protein capable of targeting one or more genomic target sites for up-regulation (increased gene activity) and a second expression cassette encoding a second translational fusion protein capable of targeting one or more genomic target sites for down-regulation (decreased gene activity), and a third expression containing a polynucleotide containing at least one gRNA designed for the purpose of activating one genomic target site and at least one gRNA designed for the purpose of repressing a second genomic target site, wherein the desired gene activation and repression patterns follow the exemplary targets sites described above are designed and/or obtained. No effort is made herein to describe all such possible combinations of plasmids.

It is expected a method for improved haploid parthenogenesis is achieved by providing to a female gametophyte, such as an egg cell, the combination of gene activities comprising of up-regulation of genes useful for haploid parthenogenesis with concurrent down-regulation of genes that inhibit haploid parthenogenesis. Of particular interest are methods to prevent inhibition of the activity of a Babyboom (BBM) polypeptide or an Ovule Development Protein 2 (ODP2). For example, achieved by repressing the expression of proteins that decrease haploid parthenogenesis, such as the results shown in Table 14.

It is expected this activity providing to a female gametophyte is provided by the paternal chromatin, here using a paternal genome possessing a haploid induction phenotype that is stably transformed with a polynucleotide containing the three expression cassettes described above. Importantly, it is expected said activity is provided to the egg cell before paternal elimination.

Following fertilization and recruitment of the dCas ribonucleotide complex to a target locus, the methods to modulate haploid parthenogenesis are achieved by altering expression of at least one gene product, including, but not limited to, post-translational modifications of histone modifications, including, but not limited to, (a) removing histone modifications associated with repressing gene expression, (b) establishing histone modifications associated with promoting gene expression, (c) recruiting transcriptional machinery associated with expressing a gene, and/or (d) inhibiting transcriptional machinery associated with expressing a gene.

Example 12: Methods for Obtaining Maternal Di-Haploids Using Haploid Induction Crosses that Modulate Haploid Parthenogenesis and Alter Cell Cycle Regulation Methods of producing maternal di-haploid plants by providing to a maternal cell of a haploid induction cross the combined genetic chromosome doubling and modulating parthenogenesis activities are disclosed herein. These combined methods further improve the in vivo frequency of maternal di-haploids obtained from haploid induction crosses. Using the methods described in Example 11, wherein haploid parthenogenesis is improved using a combination of dCas translational fusion proteins to alter gene regulation within the maternal cell, such as an egg cell, and the methods of Example 10 wherein the frequency of obtaining maternal di-haploids in vivo from haploid induction crosses is achieved using a genetic chromosome doubling method the recovery of maternal di-haploids is improved. Such maternal di-haploids are isolated as immature embryos using in vitro techniques or as mature embryos from mature seed as described in Example 10.

A haploid induction cross is made using a haploid inducer line, such as Stock 6, RWK, RWS, UH400, AX5707RS, and NP2222-matl, or any haploid inducer line that is transformed using the methods described in Example 3. The transformed haploid inducer line is used for pollen-mediated delivery of a trait construct containing the expression cassettes to modulate haploid parthenogenesis combined with expression cassettes conferring genetic chromosome doubling wherein doubled haploid populations are produced with simplified logistics, reduced cost, and increased safety.

Example 13: Methods for Obtaining Genome Modified Maternal Haploids Using a Paternal Guide RNA Molecule Methods of the present disclosure comprise integrating haploid parthenogenesis, genome modification, and genetic chromosome doubling methods to improve the in vivo frequency of maternal di-haploids from non-haploid induction crosses.

A. Obtaining a Maternal Genome Modification Using a Non-Haploid Inducer Paternal Plant Pollen from a non-haploid inducer maize inbred, for example a maize line having a wildtype patatin-like phospholipase A2 gene, transformed with a trait construct encoding at least one guide RNA molecule is used. The methods described in Examples 3 and 8 are used to obtain such a pollen donor. As described in Example 8, it is expected the line used herein as the pollen donor has reporter gene activity, such as a CFP color marker.

A selected $T_0$ maternal plant having haploid parthenogenesis, genetic chromosome doubling, and genome modification nuclease trait cassettes is used as the ear donor. The female plant is grown as described in Example 4 and is used as an ear donor that is fertilized with pollen from a non-haploid inducer maize inbred transformed with an expression cassette encoding at least one gRNA. Upon fertilization, it is expected the gRNA provided by the pollen is used by the maternally expressed gene editing nuclease and thereby modifies the genome of the maternal embryo that has also been provided the haploid parthenogenesis and chromosome doubling activities in vivo.

At approximately 14-18 days after fertilization the donor ears containing immature embryos are harvested and the immature embryos are collected for in vitro tissue culturing. Maternal haploid embryos are CFP-negative due to the absence of the paternal CFP color marker. Alternatively, seed is grown to maturity, harvested, and then CFP-negative seed is selected having a genome modified, maternal di-haploid embryo.

DNA isolated from sampled leaf material is used in molecular analysis methods. Diagnostic assays to PCR amplify the genomic target sites are used to measure the genome modification frequency and are used for genotyping purposes. Genome modified, maternal di-haploid embryos with the desired genetic mutations are selected.

Two or more paternal lines are created for use as pollen donors. Each respective paternal line is transformed with, preferentially, a polynucleotide encoding a unique set of gRNA molecules for obtaining a genome modified, maternal di-haploid embryo having the unique set of genome modifications. A first selected $T_0$ maternal plant having the haploid parthenogenesis, genetic chromosome doubling, and genome modification nuclease trait cassettes is fertilized with pollen from a paternal line having a first set of gRNAs and a second selected $T_0$ maternal plant having the haploid parthenogenesis, genetic chromosome doubling, and genome modification nuclease trait cassettes is fertilized with pollen from paternal line having a second set of gRNAs. Progeny are obtained from the first cross and from the second cross. The progeny from the from the first cross have the first set of genome modifications while progeny from the second cross have the second set of genome modifications. The respective progeny are grown and used for plant breeding efforts. For example, in a breeding program, such progeny are intercrossed to create a first-generation ($F_1$) hybrid wherein each set of the genome modifications is present in a heterozygous condition. Seed obtained from a hybrid plant is obtained, grown, and the progeny are genetically evaluated for inheritance of the optimal combination of genome modified alleles. Alternatively, the progeny are phenotypically evaluated for the optimal combination of genome modified alleles affecting phenotypic variance. Preferentially, progeny are evaluated using diagnostic assays detecting genome modifications as well as phenotypic variance.

B. Obtaining a Maternal Genome Modification Using a Haploid Inducer Paternal Plant Pollen from a haploid inducer maize inbred, for example, a maize line having a loss of function for a patatin-like phospholipase A2 gene is used. The haploid inducer line is transformed with a trait construct encoding at least one guide RNA molecule. The methods described in Examples 3 and 8 are used to obtain such a pollen donor. As described in Example 8, it is expected the line used herein as the pollen donor will have reporter gene activity and such activity is used to detect haploid and diploid embryos based on the presence and absence of the paternal reporter gene activity, respectively.

It is expected that when the methods disclosed in this Example 13, section A are practiced wherein the pollen donor is a haploid inducer line, genome modified maternal haploid embryos are obtained, for example, as immature haploid embryos or as mature seed, as described above. Further, the haploid inducer line transformed with a trait construct encoding at least one guide RNA molecule also comprises aspects of Example 10, wherein the haploid inducer paternal genome provides both a genetic chromosome doubling trait and at least one gRNA useful for editing a target site. In vivo genome-modified, di-haploid maternal embryos are obtained using the methods disclosed herein.

C. Breeding Utilities of Genome-Modified Maternal Di-Haploids

Maternal di-haploid plants are obtained using the methods disclosed herein by providing the combined modulated parthenogenesis, genetic chromosome doubling, and nuclease activities within a maternal cell, wherein the nuclease activities are programmable from at least one gRNA provided by a paternal cell. Moreover, it is expected that methods for multiplexing edits are achieved by obtaining two or more such paternal lines, where each paternal line provides to a maternal cell one or more unique gRNA molecules. It is expected that progeny derived from such a cross inheriting the corresponding targeted mutations is then used in plant breeding efforts. For example, the current method is useful for interbreeding the progeny to create a new population of progeny segregating for the accumulated mutations provided by both the first and the second pollen donor. It is expected this method of plant breeding accelerates aspects of genetic discovery and characterization efforts, particularly applicable for quantitative traits that are polygenic, meaning a phenotypic trait controlled by many genes and gene interactions.

Example 14: Use of Haploid Induction to Deliver Guide RNA Polynucleotide(S)

In this Example, haploid induction is utilized to deliver one or more guide RNA polynucleotides into a plant cell for genome editing applications. In one example of a plant cell, a *Zea mays* cell is used. In one method, the haploid inducer line delivering one or more guide RNAs does not include a pre-integrated RNA-guided enzyme such as CRISPR-Cas polypeptide (e.g., in the absence of a CRISPR-Cas polynucleotide being delivered by the haploid inducer male gamete that also delivers the guide RNAs). In one method, multiplex gRNAs are delivered by a haploid inducer line where one or more polynucleotides provide the transcriptional units for transcribing several guide RNAs that are specifically chosen to target multiple target sites in the genome.

In one method, a first *Zea mays* plant harboring one or more DNA expression cassettes transcribing a guide RNA (gRNA) is used to pollinate a second plant stably transformed with a DNA expression cassette encoding a gRNA binding protein (GBP) that when complexed with its gRNA is capable of binding, nicking or cutting a DNA target site(s). In one case, the first plant comprises a male haploid inducer line such as Stock 6 (Liu et al. (2017) *Mol. Plant.* 10, 520-522), RWK, RWS, UH400, AX5707RS, and NP2222-matl, or any haploid inducer line and the second plant a non-haploid inducing maize plant. In another instance, the first plant comprises a non-haploid inducing plant and the second plant is a maternal haploid inducing plant for example, but not limited to, a plant expressing a baby boom (bbm) gene. Following pollination, the gRNA from the male gamete is next delivered to the egg cell expressing the GBP. Optionally, the second plant need not contain a stably transformed GBP, but a polynucleotide encoding the GBP can be exogenously delivered in vitro during, at or after the haploid induction process. When combined, the gRNA and GBP form a complex capable of introducing targeted DNA edits. These can consist of DNA insertion(s), deletions(s), single nucleotide polymorphisms, inversion(s) and/or crossovers at or near the target. In some situations, the changes induced can be epigenetic resulting in changes in DNA methylation and/or histone acetylation, phosphorylation or methylation status. Offspring that have undergone haploid induction are then selected ensuring that the stably expressing gRNA expression cassette is not transferred to subsequent generations and that only maternal DNA edits are recovered. If desired, additional edits can be made to the maternal genome by pollinating the resulting haploid plant with another plant expressing the next round of gRNAs. In this way, multiple edits can be ultimately stacked into a single plant. Once editing is complete, the transgenic expression cassette encoding the GBP and optionally Bbm protein are removed from the maternal genome by pollinating with a plant encoding a Cre-Lox recombinase and/or one or more gRNAs targeting the transgenic expression cassette for scarless excision. Haploid plants that are free of the transgene are then selected and self-pollinated to fix editing outcomes. In another instance, the transgenic expression cassette is segregated away.

Example 15: Method for Producing Apomictic Plants

Figure 2:
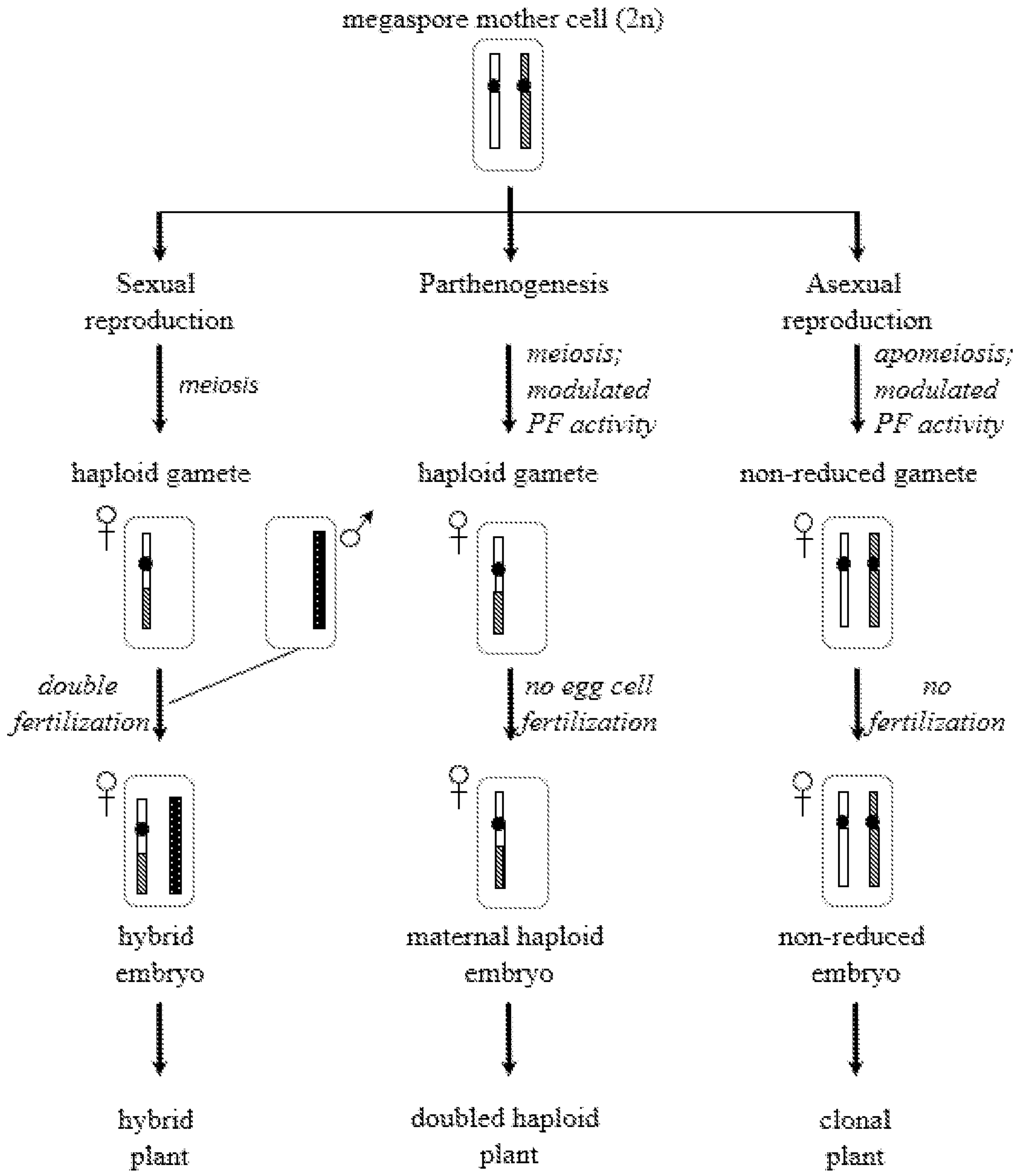
FIG. 2. shows a schematic of modes of reproduction in angiosperms. Sexual reproduction is based on meiosis and double fertilization. Meiosis has two meiotic germ cell divisions, meiosis I and meiosis II. During the first division (meiosis I), paternal and maternal chromosomes cross-over, exchanging genes before the pairs of chromosomes are separated into two haploid cells with each resulting haploid cell containing only half the number of chromosomes and two chromatid pairs. The second meiotic division (meiosis II) segregates the sister chromatids resulting in the formation of a haploid (1n) gamete. A gamete from a male and female parent unite to form a genetically unique diploid zygote that develops into a hybrid embryo. Double fertilization is a phenomenon unique to angiosperms wherein each pollen grain produces two sperm. One sperm cell nucleus is fused with an egg to form the zygote and the other is fused with the central cell in the female gametophyte to form an endosperm. Often, the second sperm fuses with two endosperm nuclei within the central cell (2n) to produce a triploid (3n) endosperm. Parthenogenesis does not involve the union of gametes and occurs in the absence of fertilization. In some cases, meiosis occurs and the haploid gamete that is formed produces a maternal haploid embryo, for example by methods of parthenogenic haploid induction. Such maternal haploid embryos can become diploidized, thereby producing a doubled haploid plant. Parthenogenesis is a mode of reproduction that requires pollination and one sperm fuses with two endosperm nuclei within the central cell to produce a triploid endosperm, herein called pseudogamy, yet there is no male inheritance of paternal chromatin within the maternal haploid embryo. Asexual reproduction in plants can be achieved by avoiding meiosis to produce a clonal, non-reduced (2n), non-recombined gamete. Such a non-reduced gamete is capable of becoming a non-reduced embryo in the absence of fertilization. The avoidance of meiosis allows a parent plant to produce an embryo that can produce a clonal plant that is genetically identical to itself in the absence of fertilization. Endosperm development without fertilization of the central cell is referred to autonomous apomixis.

Apomixis is asexual reproduction resulting in progeny that are genetically identical to the parent (FIG. 2). Methods disclosed herein are used to obtain an apomictic plant having inhibited or mutated gene products that induce mitosis instead of meiosis, the so-called "MiMe" phenotype. The MiMe phenotype is induced by inhibiting or mutating proteins necessary for efficient meiotic recombination by eliminating recombination and/or pairing. For *Zea mays* methods that provide polynucleotides and related polypeptides of Spo11, Rec8, OSD1-1A, and OSD1-3A for suppressing their expression level or activity.

The methods of the present disclosure use transformation with such expression cassettes to obtain a fie (fertility-independent endosperm)-null genetic background to promote both de novo embryo development and endosperm development without fertilization. In addition, any of the variant ODP2 DNA sequences shown in Example 4 are delivered as described above into a homozygous zygotic-embryo-lethal genotype in which only the adventive embryos produced from somatic nucellus tissue develop in the seed. Apomictic seed is obtained in the absence of pollen using these methods to obtain a non-reduced gamete (apomeiosis).

Apomictic seed is obtained by providing to a plant cell capable of producing a non-reduced gamete the protein activities described in Example 4, wherein variant ODP2 peptides were shown to improve haploid parthenogenesis relative to a native Zm-ODP2 peptide. Apomictic seed is also obtained by providing to a plant cell capable of producing a non-reduced gamete the protein activities described in Example 10, wherein at least one variant ODP2 peptide is co-expressed in a cell where at least one parthenogenesis factor is repressed. It is expected that asexual reproduction is improved in comparison to a method using only the native ZM-ODP2 peptide.

A. Obtaining Apomixis Using Modulated Haploid Parthenogenesis Combined with Genetic Mutations Conferring Apomeiosis The methods disclosed herein are useful for obtaining genetic mutations conferring apomeiosis by providing to a plant cell a gene editing trait to create a MiMe genotype, for example, a combination of mutations in three genes: SPO11-1, REC8 and OSD1. A loss of SPO11-1 function abolishes meiotic recombination. A loss of REC8 function causes the separation of sister chromatids at the first meiotic division, rather than distribution of homologous chromosomes. A loss of OSD1 function causes skipping of the second meiotic division.

Methods of the present disclosure use a gene editing trait comprising a first expression cassette encoding a CRISPR-Cas9 gene editing polynucleotide and a second expression cassette encoding gRNA molecules having sequence homology to the MiMe genes. It is expected that mutations at the MiMe gene target sites will abolish meiotic recombination. Alternatively, the methods of the present disclosure use a gene editing trait comprising a first expression cassette encoding a Cas alpha gene editing polynucleotide and a second expression cassette encoding gRNA molecules having sequence homology to the MiMe genes. The Cas alpha endonucleases described in Table 21 are useful in the methods of the present disclosure. It is expected that mutations at the MiMe gene target sites provide methods of obtaining a non-reduced gamete.

Producing and obtaining seed from a maize plant having suppressed activity with respect to its endogenous Spo11, Rec8, OSD1-1A, and OSD1-3A is challenging. For example, typically Spo11 and Rec8 heterozygotes are intercrossed to generate progeny having homozygous knockouts of Spo11 and Rec8 since homozygote loss of function mutants of Spo11 and Rec8 in maize are individually male and female sterile and cannot be intercrossed to obtain and maintain the desired double homozygous mutants. In this Example, a hybrid plant embryo is transformed with a construct containing a first trait cassette useful to obtain a MiMe genotype and a second trait cassette useful to modulate parthenogenesis. Preferentially, the transformed embryo comprises a first filial ($F_1$) hybrid genome, wherein the transformed plant produces a non-reduced embryo that is propagated as a clonal plant, such as a clonal $F_1$ hybrid plant. It is expected the seed produced from this plant produces progeny that are non-reduced, non-recombined, and clonal with respect to the parent plant when combined with approaches to modulate haploid parthenogenesis.

It is expected that various regulatory elements are useful in the Cas nuclease expression cassettes used in the methods of the present disclosure. In an aspect, it is expected that constitutive Cas nuclease expression during sporophytic growth of a transformed plant will create MiMe genotypes prior to meiotic sporogenesis. Constitutive Cas nuclease expression is achieved by operably linking the Cas nuclease to any constitutive promoter. Preferentially, the Cas nuclease is operably linked to a tissue-preferred regulatory element, or a chemically inducible regulatory element, or a gamete specific regulatory element.

In the methods of the present disclosure, a gRNA is preferentially designed with sequence homology to each genomic target site encoding its endogenous Spo11, Rec8, OSD1-1A, and OSD1-3A genes. Preferentially, the gRNA is designed to target allele-specific target regions. It is expected that each allele of each MiMe gene is targeted for genetic mutations.

Methods to create an apomictic seed having a MiMe genotype by using a gene editing trait to mutate loci encoding gene products of Spo11, Rec8, OSD1-1A, and OSD1-3 for suppressing their expression level or activity are disclosed herein. This method also uses a second trait cassette to modulate haploid parthenogenesis, for example using the methods shown in Examples 4 and 10, wherein the expression cassette containing a polynucleotide to modulate parthenogenesis is operably linked to a regulatory element acting upon a plant cell having the MiMe phenotype. Preferentially, the expression cassette that modulates parthenogenesis is operably linked to tissue-specific promoters, including promoters that are functional during meiosis. It is expected the plant cell having a MiMe phenotype will produce an increased frequency of non-reduced embryos in response to having a modulated PF activity before, during, and/or after apomeiosis.

In an aspect, plant expression cassettes, including, but not limited to, monocot or dicot expression cassettes, useful for modulating parthenogenesis are provided to the inner integument or nucellus. For example, an expression cassette for modulating parthenogenesis using a barley *Nucl* promoter (SEQ ID NO: 551) is useful in the methods of the present disclosure. It is expected that transgenic plants carrying this expression cassette will produce de novo embryos. In the case of maize, this is complemented by pollinating the ears to promote normal central cell fertilization and endosperm development.

It is expected that apomictic seed is obtained by inducing a MiMe genotype using gene editing when the cell having a MiMe phenotype is a diploid (2n) also having a modulated PF.

Upon microscopic examination of the developing embryos, it is apparent that asexual reproduction has occurred, for example, by the presence of embryo development in the absence of fertilization. Upon genetic analysis of a plant obtained from an apomictic seed it is apparent that apomixis has occurred, for example, by the presence of genome-wide heterozygous alleles consistent with the genetic composition of a first filial ($F_1$) generation (hybrid) genome.

B. Obtaining Apomixis Using Modulated Haploid Parthenogenesis Combined with Repression of Genes Conferring Meiosis As described elsewhere herein, methods to obtain a MiMe phenotype are achieved using genetic mutations. Additionally, methods to repress gene activity of loci encoding gene products inhibitory to ectopic ZM-ODP2 activity are described. In addition, methods of repression achieved using a dCas-repressor fusion protein are described. Methods to inhibit or repress in a plant cell with a MiMe phenotype loci encoding gene products of Spo11, Rec8, OSD1-1A, and OSD1-3 to suppress their expression level or activity and loci encoding gene products acting as repressors of ZM-ODP2 activity, such as the gene products described in Example 7, are disclosed herein. Specifically, a method to inhibit or repress loci encoding gene products of Spo11, Rec8, OSD1-1A, and OSD1-3 to suppress their expression level or activity and loci encoding gene products acting as repressors of ZM-ODP2 activity, while providing ZM-ODP2 peptide activity to a plant cell with a MiMe phenotype are disclosed herein. Preferentially, the ZM-ODP2 peptide is a variant ZM-ODP2 peptide conferring improved parthenogenesis as shown in Example 4.

In the methods of the present disclosure an apomictic seed used to obtain a clonal plant, preferentially of a first filial generation ($F_1$) hybrid plant, is achieved by transforming an immature embryo resulting from fertilizing a first plant providing a donor ear (female parent) with pollen from second plant (male parent). Preferentially, the two parental lines can each be inbred varietal strains exhibiting optimal phenotypic performance that are useful for producing apomictic, clonal hybrid seed. Immature embryos are collected from the fertilized donor ear and used for transformation as described in Example 3. It is expected that the transformed $F_1$ hybrid plant is hemizygous for a T-DNA construct having a first expression cassette containing a polynucleotide encoding a dCas-repressor fusion protein, a second expression cassette containing a polynucleotide encoding one or more gRNA molecules, and a third expression cassette containing a polynucleotide encoding a ZM-ODP2 peptide, such as variant ODP2 peptide showing improved parthenogenesis (see Example 4).

The first expression cassette containing a polynucleotide encoding a dCas-repressor fusion protein uses the methods described in Example 10, for example the methods wherein the repressor protein comprises a deactivated Cas-alpha peptide as a recognition domain fused to a repressor domain. The repressor domain can comprise any repressor domain. Preferentially, the method uses a fusion peptide comprising at least one repressor domain shown in Table 22.

It is expected that the method described in Example 10 represses gene expression at the genomic target sites only when the dCas repressor fusion protein is expressed. In addition, it is expected that gene expression at the genomic target sites will become de-repressed once the dCas repressor fusion protein is no longer present. A repressor domain that establishes a chromatin modification capable of repressing gene expression at the genomic target site after the dCas repressor fusion protein is no longer active and present within the treated plant cell is disclosed herein. For example, a repressor domain encoding a chromatin modifying domain comprising a SET-domain protein (with the 'SET' acronym derived from Su(var)3-9, Enhancer-of-zeste and Trithorax proteins) possessing intrinsic histone methyltransferase (HMT) activity is useful in the methods disclosed herein.

The SET-domain protein methyltransferase superfamily that methylates histones on lysine has seven main families of SET-domain proteins comprising the SUV39, SET1, SET2, E(z), RIZ, SMYD, and SUV4-20 families. The SET-domain proteins transfer a methyl group from S-adenosyl-L-methionine (AdoMet) to the amino group of a lysine residue on the histone protein, thereby establishing a methylated lysine residue on chromatin at the genomic target site wherein recruitment and binding of the SET-domain methyltransferase complex occurs. Histone methylation of specific histone lysine residues is a post-translational epigenetic modification that affects expression of genes, directly or indirectly. As an example of the latter, by establishing chromatin modifications useful for the recruitment of additional complexes that direct the organization of chromatin.

Peptides that are members of the E(z) (Enhancer of Zeste) family, such as EZH1 and EZH2. Enhancer of Zeste [E(z)] is a Polycomb-group transcriptional repressor and one of the founding members of the family of SET domain-containing proteins are useful in the methods disclosed herein. The Polycomb Repressive Complex 2 (PRC2) possesses HMT activity with specificity for Lys 9 (K9) and Lys 27 (K27) of histone H3 (herein referred to as "H3K37me3"). H3K27me3 modifications are associated with gene repression for cell type-specific genes. HMT activity of PRC2 is dependent on an intact SET domain in the E(z) protein, dCas repressor fusion domains containing a SET domain used herein to inhibit or repress loci encoding gene products of Spo11, Rec8, OSD1-1A, and OSD1-3 and used in the methods disclosed herein to inhibit or repress loci encoding gene products acting as repressors of ZM-ODP2 activity.

In this Example, an embryo for a $F_1$ hybrid plant is transformed using the methods of Example 3 using a plasmid containing a T-DNA construct having a first expression cassette containing a polynucleotide encoding a dCas-repressor fusion protein. The repressor domain contains a polynucleotide encoding a peptide possessing a SET domain conferring HMT activity. Preferentially, the repressor domain comprises an Enhancer of Zeste [E(z)] SET domain-containing protein as the shown in Table 24.

TABLE 24

| Repressor Domain | Organism | Domain | DNA SEQ ID NO: | PRT SEQ ID NO: |
|---|---|---|---|---|
| Mez1 | *Zea mays* | E(z)-SET | 540 | 545 |
| Mez2 | | | 541 | 546 |
| Mez3 | | | 542 | 547 |
| EZH2 | *Homo sapiens* | | 543 | 458 |
| EZH2 | *Mus musculus* | | 544 | 549 |

An exemplary expression cassette is provided, wherein a polynucleotide encoding a dCas-alpha10 recognition domain is fused to nuclear localization signal (VirD2 NLS) fused to a Mez1 regulatory domain (see Table 24). This expression cassette is operably linked to a megasporogenesis specific regulatory element, such as a nucellus promoter. For example, using the HV-NUC1C PRO-V1 (SEQ ID NO: 551) to obtain an expression cassette useful for repression of genes conferring meiosis, preferentially before and/or during megasporogenesis to confer an apomixis trait expression cassette (SEQ ID NO: 552) encoding a dCas-alpha10: Mez1fusion protein (SEQ ID NO: 553; encoding SEQ ID NO: 554) as an exemplary dCas-PRC2 fusion protein. Additional E(z)-SET domain containing peptides useful in the methods disclosed herein are shown in Table 24. Further, such an expression cassette can comprise additional related, conserved SET domain sequences comprising at least one N-terminus pre-SET domain, at least one C-terminus post-SET domain, or a combination thereof.

The second expression cassette contains a polynucleotide encoding one or more gRNA molecules having sequence homology to loci encoding gene products of Spo11, Rec8, OSD1-1A, and OSD1-3. Polynucleotides encoding one or more gRNA molecules having sequence homology to loci encoding gene products described in Example 7 are useful in the methods disclosed herein. This method provides to a plant cell, such as a plant cell having the MiMe phenotype an improved haploid parthenogenesis phenotype. It is expected the activity of the dCas-PRC2 fusion protein is provided to a plant cell to inhibit meiosis during sporogenesis and gametogenesis and to inhibit repressors of Zm-ODP2 activity, whereby the loci are repressed by the HMT activity conferred by the dCas-PRC2 fusion protein that establishes H3K27me3 gene repression at the genomic target sites.

The third expression cassette contains a polynucleotide encoding a ZM-ODP2 peptide, such as variant ODP2 peptide showing improved parthenogenesis (see Example 4). Additionally, the third expression cassette is capable of providing to a cell having a MiMe phenotype an improved haploid parthenogenesis phenotype resulting from the establishment of the repressive H3K27me3 modification at loci encoding gene products acting as repressors of ZM-ODP2 activity. The methods disclosed herein use a regulatory element active during meiosis, such as a regulatory element from a gene expressed during meiosis. For example, the *Zea mays* promoters for the Spo11, Rec8, OSD1-1A, or OSD1-3 loci are useful in the methods disclosed herein. An exemplary promoter provided herein is ZM-OSDL1 PRO-V1 (SEQ ID NO: 555).

In contrast to the method of disclosed in section A of this Example 15 above, here apomixis is achieved with using modulated haploid parthenogenesis combined with repression of genes conferring meiosis, wherein the genes conferring meiosis are not genetically altered. In comparison to the method of section A above, it is expected that the simultaneous inhibition of meiosis, the inhibition of genes that suppress ZM-ODP2 activity, and the concurrent ZM-ODP2 activity provided to a cell having the MiMe phenotype will improve methods to obtain a clonal, non-reduced, non-recombined embryo that is used to obtain a clonal plant and the clonal seed thereof.

Example 16: Method of Identifying and Selecting Apomictic Seed

In most types of apomixis, pseudogamy, the fertilization of the polar nuclei to produce endosperm, is necessary for seed viability. Thus, maturation of an apomictic seed obtained using the methods described in Example 11 uses single fertilization of the central cell to obtain a triploid endosperm. The triploid endosperm supports embryonic growth of the apomictic seed by supplying nutrients, protecting the apomictic embryo, and controlling embryo growth by acting as a mechanical barrier during seed development and germination.

The use of pollen for single fertilization of the central cell to obtain a triploid endosperm can preferentially comprise using a pollen donor plant having a paternal morphological marker gene to facilitate identification of apomictic seed to distinguish it from seed obtained as the result of sexual reproduction. Apomictic seed resulting from asexual reproduction will lack the paternal morphological marker gene product, whereas seed resulting from sexual reproduction will express the paternal morphological marker gene product.

A paternal morphological marker may comprise a fluorescent reporter expression construct, such as a green, yellow, or red fluorescent reporter gene, that allows the fluorescence detection in the seed and/or an allele of an anthocyanin gene, such as the R1 allele, thereby allowing visual anthocyanin detection. Alternatively, anthocyanin pigmentation in the kernel conferred by a dominant, functional C1 allele is also useful in the methods of the present disclosure, specifically the wild-type, functional colored (C1) allele. Such marker genes allow identifying sexual and asexual seed based on the presence or absence of the paternal marker gene products, respectively.

In the methods of the present disclosure, identifying sexual and asexual seed based on the presence or absence of paternal marker gene products is used to select apomictic seed from seed resulting from sexual reproduction. It is expected that sorting and selection is done using manual and/or automated methods. Automated methods for seed sorting, for example, automated seed sorting methods using machine vision or other machine learning to automate the selection process are useful in the methods of the present disclosure.

Example 17: Method of Producing Apomictic Seed Using Female Sterile Male Inbreds for Pseudogamy Apomictic seeds are produced using the methods described Example 11 and selected as described in Example 12 using a paternal pollen donor line having a morphological marker and a mutation conferring a female sterile phenotype.

Plant development is regulated by activities of the shoot apical meristem and the root apical meristem that form during embryogenesis, thus meristem maintenance and regulation is critically important for proper post-embryonic development and growth. During the transition from the vegetative to the reproductive phase in maize, the vegetative shoot apical meristem changes its fate into the inflorescence meristem that then further develops into specialized meristems comprising the branch meristem and the spikelet meristem. Mutations conferring defects in meristem formation leading to female sterility, ideally a completely barren inflorescence, are useful in the methods of the present disclosure. For example, the female sterile phenotype caused by the failure to initiate axillary meristems of the inflorescence due to loss of function of the barren inflorescence2 (bif2) gene, which is the maize ortholog of the *Arabidopsis* serine-threonine kinase PINOID is useful in the methods of the present disclosure. In addition, the female sterile phenotype caused by the barren stalk1 gene, which encodes a non-canonical basic helix-loop-helix protein required for the initiation of all aerial lateral meristems in maize is useful in the methods of the present disclosure. Other mutations conferring female sterility are useful in the methods of the present disclosure.

The methods of the present disclosure are performed by obtaining a pollen donor parent that is homozygous for a paternal morphological marker gene described in Example 12 and a female sterile phenotype, for example including, but not limited to, the mutations described in this Example 17. Apomictic seed is produced using pseudogamy wherein the triploid endosperm resulting from single fertilization of the donor ear (female parent) is not mixed with seed produced from the female flower of the pollen donor (male parent) plant.

It is expected that obtaining such a pollen donor homozygous for the paternal morphological marker with a female sterile phenotype is obtained from Mendelian segregation of the mutation conferring the female sterile phenotype from a progenitor that is heterozygous for the female sterile genotype. Preferentially, the heterozygous female sterile genotype progenitor is preserved using a maintainer line. The maintainer line is obtained by transforming a male inbred having the female sterile mutant genotype with a complementation construct containing a polynucleotide encoding a functional gene product of the mutated gene. It is expected that the progenitor seed which is heterozygous for the female sterile genotype is maintained and used to produce more seed segregating for the female sterile genotype.

Optionally, a variant of this method can include use of a marker gene unique to the construct that restores female sterility. For example, such a system can comprise a fluorescent color marker used to detect seed containing the complementation construct. It is expected that homozygous mutant seed having the female sterile genotype will therefore lack the marker gene unique to the complementation construct, thereby providing a method to identify, select, and sort the seed homozygous for the paternal morphological marker with the female sterile phenotype from the seed the containing the complementation construct.

SEQUENCE LISTING (591 sequences)

SEQ ID NO: 1 - DNA, 2133 bp, Zea mays
atggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcctcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcggccatggcggcgcgcagctcttcagtgtctggaacgacacttaa

SEQ ID NO: 2 - DNA, 1218 bp, Zea mays
atggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggataa

SEQ ID NO: 3 - DNA, 963 bp, Artificial Sequence
  ZM-ODP2 (TR6)
atggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtgggtggaggcggcagcggtggcggaggctccggaggcggtggcaggatgtctgcatgggggactgtcgtgtctgcagccgcggcggcagcagcaagcagcaacgacaacatggccgccgacgtcgggcatggcggcgcgcagctcttcagtgtctggaacgacacttaa

SEQ ID NO: 4 - DNA, 1341 bp, Zea mays
atggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcggccatggcggcgcgcagctcttcagtgtctggaacgacacttaa

SEQ ID NO: 5 - DNA, 1548 bp, Zea mays
atgatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggataa

SEQ ID NO: 6 - DNA, 1836 bp, Zea mays
atggcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcctcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggataa

SEQ ID NO: 7 - DNA, 1323 bp, Zea mays
atggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggataa

SEQ ID NO: 8 - DNA, 1308 bp, Artificial Sequence
  ZM-ODP2 (TR12)-linker-ZM-ODP2 (TR5)-V2
atgatcgggctgtccatgattaagaactggctgcggagccaaccggcgcccggtggaggcggcagcggtggcggaggctccggaggcggtggcgacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggataa

SEQ ID NO: 9 - DNA, 1290 bp, Artificial Sequence
  ZM-ODP2 (TR11)-linker-ZM-ODP2 (TR5)-V2
atggcggagccgaagctggaggacttcctcggcggtggaggcggcagcggtggcggaggctccggaggcggtggcgacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggataa

SEQ ID NO: 10 - DNA, 1380 bp, Artificial Sequence
  ZM-ODP2 (TR11)-linker-ZM-ODP2 (TR12)-linker-ZM-ODP2 (TR5)
atggcggagccgaagctggaggacttcctcggcggtggaggcggcagcggtggcggaggctccggaggcggtggcatcgggctgtccatgattaagaactggctgcggagccaaccggcgcccggtggaggcggcagcggtggcggaggctccggaggcggtggcgacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggataa

SEQ ID NO: 11 - protein, 405 aa, Zea mays
MDTFGQRTSIYRGVTRHRWTGRYEAHLWDNSCRREGQTRKGRQVYLGGYDKEEKAARAYDLAALKYWGATTTTNFPVSNYEKELEDMKHMTRQEFVASLRRKSSGFSRGASIYRGVTRHHQHGRWQARIGRVAGNKDLYLGTFSTQEEAAEAYDIAAIKFRGLNAVTNFDMSRYDVKSILDSSALPIGSAAKRLKEAEAAASAQHHHAGVVSYDVGRIASQLGDGGALAAAYGAHYHGAAWPTIAFQPGAASTGLYHPYAQQPMRGGGWCKQEQDHAVIAAAHSLQDLHHLNLGAAGAHDFFSAGQQAAAAAMHGLGSIDSASLEHSTGSNSVVYNGGVGDSNGASAVGGSGGGYMMPMSAAGATTTSAMVSHEQVHARAYDEAKQAAQMGYESYLVNAENNGGG

SEQ ID NO: 12 - protein, 320 aa, Zea mays
MATVNNWLAFSLSPQELPPSQTTDSTLISAATADHVSGDVCFNIPQDWSMRGSELSALVAEPKLEDFLGGISFSEQHHKANCNMIPSTSSTVCYASSGASTGYHHQLYHQPTSSALHFADSVMVASSAGVHDGGAMLSAAAANGVAGAASANGGGIGLSMIKNWLRSQPAPMQPRVAAAEGAQGLSLSMNMAGTTQGAAGMPLLAGERARAPESVSTSAQGGAVVVTAPKEDSGGSGVAGALVAVSTDTGGSGGASADNTARKTVGGGGSGGGGSGGGGRMSAWGTVVSAAAAAAASSNDNMAADVGHGGAQLFSVWNDT

SEQ ID NO: 13 - protein, 446 aa, Artificial Sequence
  ODP2-(1-266)-(669-710)
MDTFGQRTSIYRGVTRHRWTGRYEAHLWDNSCRREGQTRKGRQVYLGGYDKEEKAARAYDLAALKYWGATTTTNFPVSNYEKELEDMKHMTRQEFVASLRRKSSGFSRGASIYRGVTRHHQHGRWQARIGRVAGNKDLYLGTFSTQEEAAEAYDIAAIKFRGLNAVTNFDMSRYDVKSILDSSALPIGSAAKRLKEAEAAASAQHHHAGVVSYDVGRIASQLGDGGALAAAYGAHYHGAAWPTIAFQPGAASTGLYHPYAQQPMRGGGWCKQEQDHAVIAAAHSLQDLHHLNLGAAGAHDFFSAGQQAAAAAMHGLGSIDSASLEHSTGSNSVVYNGGVGDSNGASAVGGSGGGYMMPMSAAGATTTSAMVSHEQVHARAYDEAKQAAQMGYESYLVNAENNGGGRMSAWGTVVSAAAAAAASSNDNMAADVGHGGAQLFSVWNDT

SEQ ID NO: 14 - protein, 446 aa, Zea mays; identical to SEQ ID NO: 13

SEQ ID NO: 15 - protein, 515 aa, Zea mays
MIGLSMIKNWLRSQPAPMQPRVAAAEGAQGLSLSMNMAGTTQGAAGMPLLAGERARAPESVSTSAQGGAVVVTAPKEDSGGSGVAGALVAVSTDTGGSGGASADNTARKTVDTFGQRTSIYRGVTRHRWTGRYEAHLWDNSCRREGQTRKGRQVYLGGYDKEEKAARAYDLAALKYWGATTTTNFPVSNYEKELEDMKHMTRQEFVASLRRKSSGFSRGASIYRGVTRHHQHGRWQARIGRVAGNKDLYLGTFSTQEEAAEAYDIAAIKFRGLNAVTNFDMSRYDVKSILDSSALPIGSAAKRLKEAEAAASAQHHHAGVVSYDVGRIASQLGDGGALAAAYGAHYHGAAWPTIAFQPGAASTGLYHPYAQQPMRGGGWCKQEQDHAVIAAAHSLQDLHHLNLGAAGAHDFFSAGQQAAAAAMHGLGSIDSASLEHSTGSNSVVYNGGVGDSNGASAVGGSGGGYMMPMSAAGATTTSAMVSHEQVHARAYDEAKQAAQMGYESYLVNAENNGGG

SEQ ID NO: 16 - protein, 611 aa, Zea mays
MAEPKLEDFLGGISFSEQHHKANCNMIPSTSSTVCYASSGASTGYHHQLYHQPTSSALHFADSVMVASSAGVHDGGAMLSAAAANGVAGAASANGGGIGLSMIKNWLRSQPAPMQPRVAAAEGAQGLSLSMNMAGTTQGAAGMPLLAGERARAPESVSTSAQGGAVVVTAPKEDSGGSGVAGALVAVSTDTGGSGGASADNTARKTVDTFGQRTSIYRGVTRHRWTGRYEAHLWDNSCRREGQTRKGRQVYLGGYDKEEKAARAYDLAALKYWGATTTTNFPVSNYEKELEDMKHMTRQEFVASLRRKSSGFSRGASIYRGVTRHHQHGRWQARIGRVAGNKDLYLGTFSTQEEAAEAYDIAAIKFRGLNAVTNFDMSRYDVKSILDSSALPIGSAAKRLKEAEAAASAQHHHAGVVSYDVGRIASQLGDGGALAAAYGAHYHGAAWPTIAFQPGAASTGLYHPYAQQPMRGGGWCKQEQDHAVIAAAHSLQDLHHLNLGAAGAHDFFSAGQQAAAAAMHGLGSIDSASLEHSTGSNSVVYNGGVGDSNGASAVGGSGGGYMMPMSAAGATTTSAMVSHEQVHARAYDEAKQAAQMGYESYLVNAENNGGG

SEQ ID NO: 17 - protein, 440 aa, Zea mays
MEDSGGSGVAGALVAVSTDTGGSGGASADNTARKTVDTFGQRTSIYRGVTRHRWTGRYEAHLWDNSCRREGQTRKGRQVYLGGYDKEEKAARAYDLAALKYWGATTTTNFPVSNYEKELEDMKHMTRQEFVASLRRKSSGFSRGASIYRGVTRHHQHGRWQARIGRVAGNKDLYLGTFSTQEEAAEAYDIAAIKFRGLNAVTNFDMSRYDVKSILDSSALPIGSAAKRLKEAEAAASAQHHHAGVVSYDVGRIASQLGDGGALAAAYGAHYHGAAWPTIAFQPGAASTGLYHPYAQQPMRGGGWCKQEQDHAVIAAAHSLQDLHHLNLGAAGAHDFFSAGQQAAAAAMHGLGSIDSASLEHSTGSNSVVYNGGVGDSNGASAVGGSGGGYMMPMSAAGATTTSAMVSHEQVHARAYDEAKQAAQMGYESYLVNAENNGGG

SEQ ID NO: 18 - protein, 435 aa, Artificial Sequence
  ODP2-(156-171)-(266-669)
MIGLSMIKNWLRSQPAPGGGGSGGGGSGGGGDTFGQRTSIYRGVTRHRWTGRYEAHLWDNSCRREGQTRKGRQVYLGGYDKEEKAARAYDLAALKYWGATTTTNFPVSNYEKELEDMKHMTRQEFVASLRRKSSGFSRGASIYRGVTRHHQHGRWQARIGRVAGNKDLYLGTFSTQEEAAEAYDIAAIKFRGLNAVTNFDMSRYDVKSILDSSALPIGSAAKRLKEAEAAASAQHHHAGVVSYDVGRIASQLGDGGALAAAYGAHYHGAAWPTIAFQPGAASTGLYHPYAQQPMRGGGWCKQEQDHAVIAAAHSLQDLHHLNLGAAGAHDFFSAGQQAAAAAMHGLGSIDSASLEHSTGSNSVVYNGGVGDSNGASAVGGSGGGYMMPMSAAGATTTSAMVSHEQVHARAYDEAKQAAQMGYESYLVNAENNGGG

SEQ ID NO: 19 - protein, 429 aa, Artificial Sequence
  ODP2-(60-69)-(266-669)
MAEPKLEDFLGGGGGSGGGGSGGGGDTFGQRTSIYRGVTRHRWTGRYEAHLWDNSCRREGQTRKGRQVYLGGYDKEEKAARAYDLAALKYWGATTTTNFPVSNYEKELEDMKHMTRQEFVASLRRKSSGFSRGASIYRGVTRHHQHGRWQARIGRVAGNKDLYLGTFSTQEEAAEAYDIAAIKFRGLNAVTNFDMSRYDVKSILDSSALPIGSAAKRLKEAEAAASAQHHHAGVVSYDVGRIASQLGDGGALAAAYGAHYHGAAWPTIAFQPGAASTGLYHPYAQQPMRGGGWCKQEQDHAVIAAAHSLQDLHHLNLGAAGAHDFFSAGQQAAAAAMHGLGSIDSASLEHSTGSNSVVYNGGVGDSNGASAVGGSGGGYMMPMSAAGATTTSAMVSHEQVHARAYDEAKQAAQMGYESYLVNAENNGGG

SEQ ID NO: 20 - protein, 459 aa, Artificial Sequence
  ODP2-(60-69)-(156-171)-(266-669)
MAEPKLEDFLGGGGGSGGGGSGGGGIGLSMIKNWLRSQPAPGGGGSGGGGSGGGGDTFGQRTSIYRGVTRHRWTGRYEAHLWDNSCRREGQTRKGRQVYLGGYDKEEKAARAYDLAALKYWGATTTTNFPVSNYEKELEDMKHMTRQEFVASLRRKSSGFSRGASIYRGVTRHHQHGRWQARIGRVAGNKDLYLGTFSTQEEAAEAYDIAAIKFRGLNAVTNFDMSRYDVKSILDSSALPIGSAAKRLKEAEAAASAQHHHAGVVSYDVGRIASQLGDGGALAAAYGAHYHGAAWPTIAFQPGAASTGLYHPYAQQPMRGGGWCKQEQDHAVIAAAHSLQDLHHLNLGAAGAHDFFSAGQQAAAAAMHGLGSIDSASLEHSTGSNSVVYNGGVGDSNGASAVGGSGGGYMMPMSAAGATTTSAMVSHEQVHARAYDEAKQAAQMGYESYLVNAENNGGG

SEQ ID NO: 21 - DNA, 26227 bp, Artificial Sequence
  PHP94831
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatctgcggttaccgaattcgagctcggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtaagtttctgcttctacctttgatatatatataataattatcattaattagtagtaatataatatttcaaatatttttttcaaaataaaagaatgtagtatatagcaattgcttttctgtagtttataacttcgtatagcatacattatacgaagttatacttttctaatatatgaccaaaatttgttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccgggatctgagtcgaaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagatcgatgggccctggccgaagcttggtcacccggtccgggcctagaaggccagcttcaagtttgtaccctggagcttgccgagtgccatccttggacactcgataaagtatattttattttttttattttgccaaccaaactttttgtggtatgttcctacactatgtagatctacatgtaccattttggcacaattacatatttacaaaaatgttttctataaatattagatttagttcgtttatttgaatttcttcggaaaattcacatttaaactgcaagtcactcgaaacatggaaaaccgtgcatgcaaaataaatgatatgcatgttatctagcacaagttacgaccgatttcagaagcagaccagaatcttcaagcaccatgctcactaaacatgaccgtgaacttgttatctagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtactcgacaaagaagccgttgtcgatgtactgttcgtcgagatctctttgtcgagtgtcacactaggcaaagtctttacggagtgtttttcaggctttgacactcggcaaagcgctcgattccagtagtgacagtaatttgcatcaaaaatagctgagagatttaggccccgtttcaatctcacgggataaagtttagcttcctgctaaactttagctatatgaattgaagtgctaaagtttagtttcaattaccaccattagctctcctgtttagattacaaatggctaaaagtagctaaaaaatagctgctaaagtttatctcgcgagattgaaacagggccttaaaatgagtcaactaatagaccaactaattattagctattagtcgttagcttctttaatctaagctaaaaccaactaatagcttatttgttgaattacaattagctcaacggaattctctgtttttctaaaaaaaaactgcccctctcttacagcaaattgtccgctgcccgtcgtccagatacaatgaacgtacctagtaggaactcttttacacgctcggtcgctcgccgcggatcggagtccccggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaaggatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgagctagacccagctttcttgtacaaagtggccgttaacggatccagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcaagctgttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccatttcaaatatttttttcaaaataaaagaatgtagtatatagcaattgcttttctgtagtttataacttcgtatagcatacattatacgaagttatacttttctaatatatgaccaaaatttgttgatgtgcaggtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgatgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacataaagctttccactggttgccatatatgatttgggcatttcactttgatcttaatgggccttgtaaagcccaagactcatgattatctttagttgatgctcttaattaggtgtgggcaaataattcaaactgtatgtacccgaccaaaaccaaagcaaaaataatcgaaccaaaccgaaaatttaaaaataaccgaatgaaaactaaatcctataactgaaagaactgaaaccgaatcaaaatatttaatgtaaccaaaaatatccgaaatataattatattgtcaaaaatattaataatttctagattaaataattaaaaatacttaaaaatttatataaaatagtaaaaatactcgaaaataaccacaaatattcaaaaacaaccgaaatatcccaaaatattcaaagcaaaataaccgaatggataccaaattttaaaaccgaaaaaactggaacaaaaccaaaatcgaaccaaaatttcaaaaatcgaataaatactaaactttagaacaaaaaaaaacgataaccgaatgtatacgaaccaaagccgaattagataaccgaacgtccaggactactcttaatctttccgccacttatgatttgggctattactttgtttataatgagccttttcaagctcaagttcatgattgtccgtgagatgagaaactgacttgttggattcgaaaccctagctagtattggttaatacttaatacataaatgacctgcattgacatcatcatccaagaaaataaaaattgtatgcttgagatatttagttttcctagctaggttttctttattttagtaccgaatctttaggtgtgccacgttaatttagacccattttttcatacttaccaactgagtctagtttaatcatgactataatcgtataaaatgattcagtcgacgtcattgcgaacgtatataaaatcatccaaattgacgtcattccaaagaggtaagcatgcttatctaagagtccgagcatactaaacaagacgacattttatttgcactccaaatcaaattttgtattgcctaaagaaaaacaatcaaactcaagtttcttaaaattaatttcattcaaactaatcactttcaatatctcacatattattcatgccatttctatttgtctaaacatgatttaaaaaaaaaagtaaaatacaaagattactatgcaaaaactctataaaaaaaaattcaaatttcttatttatttgtgacatcaaattttcaaaataatttttttaattatcggttgatccggtcagtcgataaaaacataaactttcagcgaccgttaaaactttcctactaccgatttagagaaaatcttagcttgaaacgtaattgtaacctgccttcatgcaagtcgcaagatatgtcatcctaagttgtatatgttttctcaaaagatgtatttacttgagaaaatacgtttcaacgttgatggacaaccaattaagaatcaagcacctttcgtaatcaatttaggcttatcgtctaaggtatactgatttacgacagttgactagacttataaggaacaaaataatagaatagtttctaaacacttcacctaatcatagagactaagatggtaattcgtaaacgacaaagcctagtgacactgtccattgtaaaattccacatcatattagtattaaacatatacatgtagtttcctgaacacatgtagtatcaaacacacttcgtggcttcttcctcgaaacctgcggccgctcattaattaagtcatctagttgaaggatcgctatcaactttgtatagaaaagttgggccgaattcgagctcggtacggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcctcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcggccatggcggcgcgcagctcttcagtgtctggaacgacacttaaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgggttaccgaattcgagctcggtaccctgggatccgatatcgatgggccctggccgaagcttggtcacccggtccgggcctagaaggccgatctcccgggcacccagctttcttgtacaaagtggccgttaacggatcggccagaatggcccggaccgggttaccgaattcgagctcggtaccctgggatccgatatcgatgggccctggccgaagcttggtcacccggtccgggcctagaaggccagcttcggccgccccgggcaactttattatacaaagttgatagatcctcatgtcttcatcgtaagcttaaacaggccagaatggcctctggattcagcggcctagaaggccgaagtacttggtcttcctagtcgagtagatcacattcaagcttggtcacccggtccgtcaatattctgattccgatgacttcgtaggttcctagctcaagccgctcgtgtccaagcgtcacttacgattagctaatgattacggcatctaggaccgactagtggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 22 - DNA, 25312 bp, Artificial Sequence
  PHP92900
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatctgcggttaccgaattcgagctcggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtaagtttctgcttctacctttgatatatatataataattatcattaattagtagtaatataatatttcaaatatttttttcaaaataaaagaatgtagtatatagcaattgcttttctgtagtttataacttcgtatagcatacattatacgaagttatacttttctaatatatgaccaaaatttgttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccgggatctgagtcgaaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagatcgatgggccctggccgaagcttggtcacccggtccgggcctagaaggccagcttcaagtttgtaccctggagcttgccgagtgccatccttggacactcgataaagtatattttattttttttattttgccaaccaaactttttgtggtatgttcctacactatgtagatctacatgtaccattttggcacaattacatatttacaaaaatgttttctataaatattagatttagttcgtttatttgaatttcttcggaaaattcacatttaaactgcaagtcactcgaaacatggaaaaccgtgcatgcaaaataaatgatatgcatgttatctagcacaagttacgaccgatttcagaagcagaccagaatcttcaagcaccatgctcactaaacatgaccgtgaacttgttatctagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtactcgacaaagaagccgttgtcgatgtactgttcgtcgagatctctttgtcgagtgtcacactaggcaaagtctttacggagtgtttttcaggctttgacactcggcaaagcgctcgattccagtagtgacagtaatttgcatcaaaaatagctgagagatttaggccccgtttcaatctcacgggataaagtttagcttcctgctaaactttagctatatgaattgaagtgctaaagtttagtttcaattaccaccattagctctcctgtttagattacaaatggctaaaagtagctaaaaaatagctgctaaagtttatctcgcgagattgaaacagggccttaaaatgagtcaactaatagaccaactaattattagctattagtcgttagcttctttaatctaagctaaaaccaactaatagcttatttgttgaattacaattagctcaacggaattctctgtttttctaaaaaaaaactgcccctctcttacagcaaattgtccgctgcccgtcgtccagatacaatgaacgtacctagtaggaactcttttacacgctcggtcgctcgccgcggatcggagtccccggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaaggatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgagctagacccagctttcttgtacaaagtggccgttaacggatccagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcaagctgttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccatttcaaatatttttttcaaaataaaagaatgtagtatatagcaattgcttttctgtagtttataacttcgtatagcatacattatacgaagttatacttttctaatatatgaccaaaatttgttgatgtgcaggtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgatgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacataaagctttccactggttgccatatatgatttgggcatttcactttgatcttaatgggccttgtaaagcccaagactcatgattatctttagttgatgctcttaattaggtgtgggcaaataattcaaactgtatgtacccgaccaaaaccaaagcaaaaataatcgaaccaaaccgaaaatttaaaaataaccgaatgaaaactaaatcctataactgaaagaactgaaaccgaatcaaaatatttaatgtaaccaaaaatatccgaaatataattatattgtcaaaaatattaataatttctagattaaataattaaaaatacttaaaaatttatataaaatagtaaaaatactcgaaaataaccacaaatattcaaaaacaaccgaaatatcccaaaatattcaaagcaaaataaccgaatggataccaaattttaaaaccgaaaaaactggaacaaaaccaaaatcgaaccaaaatttcaaaaatcgaataaatactaaactttagaacaaaaaaaaacgataaccgaatgtatacgaaccaaagccgaattagataaccgaacgtccaggactactcttaatctttccgccacttatgatttgggctattactttgtttataatgagccttttcaagctcaagttcatgattgtccgtgagatgagaaactgacttgttggattcgaaaccctagctagtattggttaatacttaatacataaatgacctgcattgacatcatcatccaagaaaataaaaattgtatgcttgagatatttagttttcctagctaggttttctttattttagtaccgaatctttaggtgtgccacgttaatttagacccattttttcatacttaccaactgagtctagtttaatcatgactataatcgtataaaatgattcagtcgacgtcattgcgaacgtatataaaatcatccaaattgacgtcattccaaagaggtaagcatgcttatctaagagtccgagcatactaaacaagacgacattttatttgcactccaaatcaaattttgtattgcctaaagaaaaacaatcaaactcaagtttcttaaaattaatttcattcaaactaatcactttcaatatctcacatattattcatgccatttctatttgtctaaacatgatttaaaaaaaaaagtaaaatacaaagattactatgcaaaaactctataaaaaaaaattcaaatttcttatttatttgtgacatcaaattttcaaaataatttttttaattatcggttgatccggtcagtcgataaaaacataaactttcagcgaccgttaaaactttcctactaccgatttagagaaaatcttagcttgaaacgtaattgtaacctgccttcatgcaagtcgcaagatatgtcatcctaagttgtatatgttttctcaaaagatgtatttacttgagaaaatacgtttcaacgttgatggacaaccaattaagaatcaagcacctttcgtaatcaatttaggcttatcgtctaaggtatactgatttacgacagttgactagacttataaggaacaaaataatagaatagtttctaaacacttcacctaatcatagagactaagatggtaattcgtaaacgacaaagcctagtgacactgtccattgtaaaattccacatcatattagtattaaacatatacatgtagtttcctgaacacatgtagtatcaaacacacttcgtggcttcttcctcgaaacctgcggccgctcattaattaagtcatctagttgaaggatcgctatcaactttgtatagaaaagttgggccgaattcgagctcggtacggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggataaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgggttaccgaattcgagctcggtaccctgggatccgatatcgatgggccctggccgaagcttggtcacccggtccgggcctagaaggccgatctcccgggcacccagctttcttgtacaaagtggccgttaacggatcggccagaatggcccggaccgggttaccgaattcgagctcggtaccctgggatccgatatcgatgggccctggccgaagcttggtcacccggtccgggcctagaaggccagcttcggccgccccgggcaactttattatacaaagttgatagatcctcatgtcttcatcgtaagcttaaacaggccagaatggcctctggattcagcggcctagaaggccgaagtacttggtcttcctagtcgagtagatcacattcaagcttggtcacccggtccgtcaatattctgattccgatgacttcgtaggttcctagctcaagccgctcgtgtccaagcgtcacttacgattagctaatgattacggcatctaggaccgactagtggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 23 - DNA, 25057 bp, Artificial Sequence
  RV036687
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatctgcggttaccgaattcgagctcggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtaagtttctgcttctacctttgatatatatataataattatcattaattagtagtaatataatatttcaaatatttttttcaaaataaaagaatgtagtatatagcaattgcttttctgtagtttataacttcgtatagcatacattatacgaagttatacttttctaatatatgaccaaaatttgttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccgggatctgagtcgaaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagatcgatgggccctggccgaagcttggtcacccggtccgggcctagaaggccagcttcaagtttgtaccctggagcttgccgagtgccatccttggacactcgataaagtatattttattttttttattttgccaaccaaactttttgtggtatgttcctacactatgtagatctacatgtaccattttggcacaattacatatttacaaaaatgttttctataaatattagatttagttcgtttatttgaatttcttcggaaaattcacatttaaactgcaagtcactcgaaacatggaaaaccgtgcatgcaaaataaatgatatgcatgttatctagcacaagttacgaccgatttcagaagcagaccagaatcttcaagcaccatgctcactaaacatgaccgtgaacttgttatctagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtactcgacaaagaagccgttgtcgatgtactgttcgtcgagatctctttgtcgagtgtcacactaggcaaagtctttacggagtgtttttcaggctttgacactcggcaaagcgctcgattccagtagtgacagtaatttgcatcaaaaatagctgagagatttaggccccgtttcaatctcacgggataaagtttagcttcctgctaaactttagctatatgaattgaagtgctaaagtttagtttcaattaccaccattagctctcctgtttagattacaaatggctaaaagtagctaaaaaatagctgctaaagtttatctcgcgagattgaaacagggccttaaaatgagtcaactaatagaccaactaattattagctattagtcgttagcttctttaatctaagctaaaaccaactaatagcttatttgttgaattacaattagctcaacggaattctctgtttttctaaaaaaaaactgcccctctcttacagcaaattgtccgctgcccgtcgtccagatacaatgaacgtacctagtaggaactcttttacacgctcggtcgctcgccgcggatcggagtccccggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaaggatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgagctagacccagctttcttgtacaaagtggccgttaacggatccagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcaagctgttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccatttcaaatatttttttcaaaataaaagaatgtagtatatagcaattgcttttctgtagtttataacttcgtatagcatacattatacgaagttatacttttctaatatatgaccaaaatttgttgatgtgcaggtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgatgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacataaagctttccactggttgccatatatgatttgggcatttcactttgatcttaatgggccttgtaaagcccaagactcatgattatctttagttgatgctcttaattaggtgtgggcaaataattcaaactgtatgtacccgaccaaaaccaaagcaaaaataatcgaaccaaaccgaaaatttaaaaataaccgaatgaaaactaaatcctataactgaaagaactgaaaccgaatcaaaatatttaatgtaaccaaaaatatccgaaatataattatattgtcaaaaatattaataatttctagattaaataattaaaaatacttaaaaatttatataaaatagtaaaaatactcgaaaataaccacaaatattcaaaaacaaccgaaatatcccaaaatattcaaagcaaaataaccgaatggataccaaattttaaaaccgaaaaaactggaacaaaaccaaaatcgaaccaaaatttcaaaaatcgaataaatactaaactttagaacaaaaaaaaacgataaccgaatgtatacgaaccaaagccgaattagataaccgaacgtccaggactactcttaatctttccgccacttatgatttgggctattactttgtttataatgagccttttcaagctcaagttcatgattgtccgtgagatgagaaactgacttgttggattcgaaaccctagctagtattggttaatacttaatacataaatgacctgcattgacatcatcatccaagaaaataaaaattgtatgcttgagatatttagttttcctagctaggttttctttattttagtaccgaatctttaggtgtgccacgttaatttagacccattttttcatacttaccaactgagtctagtttaatcatgactataatcgtataaaatgattcagtcgacgtcattgcgaacgtatataaaatcatccaaattgacgtcattccaaagaggtaagcatgcttatctaagagtccgagcatactaaacaagacgacattttatttgcactccaaatcaaattttgtattgcctaaagaaaaacaatcaaactcaagtttcttaaaattaatttcattcaaactaatcactttcaatatctcacatattattcatgccatttctatttgtctaaacatgatttaaaaaaaaaagtaaaatacaaagattactatgcaaaaactctataaaaaaaaattcaaatttcttatttatttgtgacatcaaattttcaaaataatttttttaattatcggttgatccggtcagtcgataaaaacataaactttcagcgaccgttaaaactttcctactaccgatttagagaaaatcttagcttgaaacgtaattgtaacctgccttcatgcaagtcgcaagatatgtcatcctaagttgtatatgttttctcaaaagatgtatttacttgagaaaatacgtttcaacgttgatggacaaccaattaagaatcaagcacctttcgtaatcaatttaggcttatcgtctaaggtatactgatttacgacagttgactagacttataaggaacaaaataatagaatagtttctaaacacttcacctaatcatagagactaagatggtaattcgtaaacgacaaagcctagtgacactgtccattgtaaaattccacatcatattagtattaaacatatacatgtagtttcctgaacacatgtagtatcaaacacacttcgtggcttcttcctcgaaacctgcggccgctcattaattaagtcatctagttgaaggatcgctatcaactttgtatagaaaagttgggccgaattcgagctcggtacggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtgggtggaggcggcagcggtggcggaggctccggaggcggtggcaggatgtctgcatgggggactgtcgtgtctgcagccgcggcggcagcagcaagcagcaacgacaacatggccgccgacgtcgggcatggcggcgcgcagctcttcagtgtctggaacgacacttaaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgggttaccgaattcgagctcggtaccctgggatccgatatcgatgggccctggccgaagcttggtcacccggtccgggcctagaaggccgatctcccgggcacccagctttcttgtacaaagtggccgttaacggatcggccagaatggcccggaccgggttaccgaattcgagctcggtaccctgggatccgatatcgatgggccctggccgaagcttggtcacccggtccgggcctagaaggccagcttcggccgccccgggcaactttattatacaaagttgatagatcctcatgtcttcatcgtaagcttaaacaggccagaatggcctctggattcagcggcctagaaggccgaagtacttggtcttcctagtcgagtagatcacattcaagcttggtcacccggtccgtcaatattctgattccgatgacttcgtaggttcctagctcaagccgctcgtgtccaagcgtcacttacgattagctaatgattacggcatctaggaccgactagtggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 24 - DNA, 25435 bp, Artificial Sequence
  RV036691
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatctgcggttaccgaattcgagctcggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtaagtttctgcttctacctttgatatatatataataattatcattaattagtagtaatataatatttcaaatatttttttcaaaataaaagaatgtagtatatagcaattgcttttctgtagtttataacttcgtatagcatacattatacgaagttatacttttctaatatatgaccaaaatttgttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccgggatctgagtcgaaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagatcgatgggccctggccgaagcttggtcacccggtccgggcctagaaggccagcttcaagtttgtaccctggagcttgccgagtgccatccttggacactcgataaagtatattttattttttttattttgccaaccaaactttttgtggtatgttcctacactatgtagatctacatgtaccattttggcacaattacatatttacaaaaatgttttctataaatattagatttagttcgtttatttgaatttcttcggaaaattcacatttaaactgcaagtcactcgaaacatggaaaaccgtgcatgcaaaataaatgatatgcatgttatctagcacaagttacgaccgatttcagaagcagaccagaatcttcaagcaccatgctcactaaacatgaccgtgaacttgttatctagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtactcgacaaagaagccgttgtcgatgtactgttcgtcgagatctctttgtcgagtgtcacactaggcaaagtctttacggagtgtttttcaggctttgacactcggcaaagcgctcgattccagtagtgacagtaatttgcatcaaaaatagctgagagatttaggccccgtttcaatctcacgggataaagtttagcttcctgctaaactttagctatatgaattgaagtgctaaagtttagtttcaattaccaccattagctctcctgtttagattacaaatggctaaaagtagctaaaaaatagctgctaaagtttatctcgcgagattgaaacagggccttaaaatgagtcaactaatagaccaactaattattagctattagtcgttagcttctttaatctaagctaaaaccaactaatagcttatttgttgaattacaattagctcaacggaattctctgtttttctaaaaaaaaactgcccctctcttacagcaaattgtccgctgcccgtcgtccagatacaatgaacgtacctagtaggaactcttttacacgctcggtcgctcgccgcggatcggagtccccggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaaggatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgagctagacccagctttcttgtacaaagtggccgttaacggatccagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcaagctgttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccatttcaaatatttttttcaaaataaaagaatgtagtatatagcaattgcttttctgtagtttataacttcgtatagcatacattatacgaagttatacttttctaatatatgaccaaaatttgttgatgtgcaggtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgatgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacataaagctttccactggttgccatatatgatttgggcatttcactttgatcttaatgggccttgtaaagcccaagactcatgattatctttagttgatgctcttaattaggtgtgggcaaataattcaaactgtatgtacccgaccaaaaccaaagcaaaaataatcgaaccaaaccgaaaatttaaaaataaccgaatgaaaactaaatcctataactgaaagaactgaaaccgaatcaaaatatttaatgtaaccaaaaatatccgaaatataattatattgtcaaaaatattaataatttctagattaaataattaaaaatacttaaaaatttatataaaatagtaaaaatactcgaaaataaccacaaatattcaaaaacaaccgaaatatcccaaaatattcaaagcaaaataaccgaatggataccaaattttaaaaccgaaaaaactggaacaaaaccaaaatcgaaccaaaatttcaaaaatcgaataaatactaaactttagaacaaaaaaaaacgataaccgaatgtatacgaaccaaagccgaattagataaccgaacgtccaggactactcttaatctttccgccacttatgatttgggctattactttgtttataatgagccttttcaagctcaagttcatgattgtccgtgagatgagaaactgacttgttggattcgaaaccctagctagtattggttaatacttaatacataaatgacctgcattgacatcatcatccaagaaaataaaaattgtatgcttgagatatttagttttcctagctaggttttctttattttagtaccgaatctttaggtgtgccacgttaatttagacccattttttcatacttaccaactgagtctagtttaatcatgactataatcgtataaaatgattcagtcgacgtcattgcgaacgtatataaaatcatccaaattgacgtcattccaaagaggtaagcatgcttatctaagagtccgagcatactaaacaagacgacattttatttgcactccaaatcaaattttgtattgcctaaagaaaaacaatcaaactcaagtttcttaaaattaatttcattcaaactaatcactttcaatatctcacatattattcatgccatttctatttgtctaaacatgatttaaaaaaaaaagtaaaatacaaagattactatgcaaaaactctataaaaaaaaattcaaatttcttatttatttgtgacatcaaattttcaaaataatttttttaattatcggttgatccggtcagtcgataaaaacataaactttcagcgaccgttaaaactttcctactaccgatttagagaaaatcttagcttgaaacgtaattgtaacctgccttcatgcaagtcgcaagatatgtcatcctaagttgtatatgttttctcaaaagatgtatttacttgagaaaatacgtttcaacgttgatggacaaccaattaagaatcaagcacctttcgtaatcaatttaggcttatcgtctaaggtatactgatttacgacagttgactagacttataaggaacaaaataatagaatagtttctaaacacttcacctaatcatagagactaagatggtaattcgtaaacgacaaagcctagtgacactgtccattgtaaaattccacatcatattagtattaaacatatacatgtagtttcctgaacacatgtagtatcaaacacacttcgtggcttcttcctcgaaacctgcggccgctcattaattaagtcatctagttgaaggatcgctatcaactttgtatagaaaagttgggccgaattcgagctcggtacggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcggccatggcggcgcgcagctcttcagtgtctggaacgacacttaaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgggttaccgaattcgagctcggtaccctgggatccgatatcgatgggccctggccgaagcttggtcacccggtccgggcctagaaggccgatctcccgggcacccagctttcttgtacaaagtggccgttaacggatcggccagaatggcccggaccgggttaccgaattcgagctcggtaccctgggatccgatatcgatgggccctggccgaagcttggtcacccggtccgggcctagaaggccagcttcggccgccccgggcaactttattatacaaagttgatagatcctcatgtcttcatcgtaagcttaaacaggccagaatggcctctggattcagcggcctagaaggccgaagtacttggtcttcctagtcgagtagatcacattcaagcttggtcacccggtccgtcaatattctgattccgatgacttcgtaggttcctagctcaagccgctcgtgtccaagcgtcacttacgattagctaatgattacggcatctaggaccgactagtggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 25 - DNA, 25642 bp, Artificial Sequence
  RV036689
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatctgcggttaccgaattcgagctcggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtaagtttctgcttctacctttgatatatatataataattatcattaattagtagtaatataatatttcaaatatttttttcaaaataaaagaatgtagtatatagcaattgcttttctgtagtttataacttcgtatagcatacattatacgaagttatacttttctaatatatgaccaaaatttgttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccgggatctgagtcgaaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagatcgatgggccctggccgaagcttggtcacccggtccgggcctagaaggccagcttcaagtttgtaccctggagcttgccgagtgccatccttggacactcgataaagtatattttattttttttattttgccaaccaaactttttgtggtatgttcctacactatgtagatctacatgtaccattttggcacaattacatatttacaaaaatgttttctataaatattagatttagttcgtttatttgaatttcttcggaaaattcacatttaaactgcaagtcactcgaaacatggaaaaccgtgcatgcaaaataaatgatatgcatgttatctagcacaagttacgaccgatttcagaagcagaccagaatcttcaagcaccatgctcactaaacatgaccgtgaacttgttatctagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtactcgacaaagaagccgttgtcgatgtactgttcgtcgagatctctttgtcgagtgtcacactaggcaaagtctttacggagtgtttttcaggctttgacactcggcaaagcgctcgattccagtagtgacagtaatttgcatcaaaaatagctgagagatttaggccccgtttcaatctcacgggataaagtttagcttcctgctaaactttagctatatgaattgaagtgctaaagtttagtttcaattaccaccattagctctcctgtttagattacaaatggctaaaagtagctaaaaaatagctgctaaagtttatctcgcgagattgaaacagggccttaaaatgagtcaactaatagaccaactaattattagctattagtcgttagcttctttaatctaagctaaaaccaactaatagcttatttgttgaattacaattagctcaacggaattctctgtttttctaaaaaaaaactgcccctctcttacagcaaattgtccgctgcccgtcgtccagatacaatgaacgtacctagtaggaactcttttacacgctcggtcgctcgccgcggatcggagtccccggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaaggatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgagctagacccagctttcttgtacaaagtggccgttaacggatccagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcaagctgttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccatttcaaatatttttttcaaaataaaagaatgtagtatatagcaattgcttttctgtagtttataacttcgtatagcatacattatacgaagttatacttttctaatatatgaccaaaatttgttgatgtgcaggtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgatgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacataaagctttccactggttgccatatatgatttgggcatttcactttgatcttaatgggccttgtaaagcccaagactcatgattatctttagttgatgctcttaattaggtgtgggcaaataattcaaactgtatgtacccgaccaaaaccaaagcaaaaataatcgaaccaaaccgaaaatttaaaaataaccgaatgaaaactaaatcctataactgaaagaactgaaaccgaatcaaaatatttaatgtaaccaaaaatatccgaaatataattatattgtcaaaaatattaataatttctagattaaataattaaaaatacttaaaaatttatataaaatagtaaaaatactcgaaaataaccacaaatattcaaaaacaaccgaaatatcccaaaatattcaaagcaaaataaccgaatggataccaaattttaaaaccgaaaaaactggaacaaaaccaaaatcgaaccaaaatttcaaaaatcgaataaatactaaactttagaacaaaaaaaaacgataaccgaatgtatacgaaccaaagccgaattagataaccgaacgtccaggactactcttaatctttccgccacttatgatttgggctattactttgtttataatgagccttttcaagctcaagttcatgattgtccgtgagatgagaaactgacttgttggattcgaaaccctagctagtattggttaatacttaatacataaatgacctgcattgacatcatcatccaagaaaataaaaattgtatgcttgagatatttagttttcctagctaggttttctttattttagtaccgaatctttaggtgtgccacgttaatttagacccattttttcatacttaccaactgagtctagtttaatcatgactataatcgtataaaatgattcagtcgacgtcattgcgaacgtatataaaatcatccaaattgacgtcattccaaagaggtaagcatgcttatctaagagtccgagcatactaaacaagacgacattttatttgcactccaaatcaaattttgtattgcctaaagaaaaacaatcaaactcaagtttcttaaaattaatttcattcaaactaatcactttcaatatctcacatattattcatgccatttctatttgtctaaacatgatttaaaaaaaaaagtaaaatacaaagattactatgcaaaaactctataaaaaaaaattcaaatttcttatttatttgtgacatcaaattttcaaaataatttttttaattatcggttgatccggtcagtcgataaaaacataaactttcagcgaccgttaaaactttcctactaccgatttagagaaaatcttagcttgaaacgtaattgtaacctgccttcatgcaagtcgcaagatatgtcatcctaagttgtatatgttttctcaaaagatgtatttacttgagaaaatacgtttcaacgttgatggacaaccaattaagaatcaagcacctttcgtaatcaatttaggcttatcgtctaaggtatactgatttacgacagttgactagacttataaggaacaaaataatagaatagtttctaaacacttcacctaatcatagagactaagatggtaattcgtaaacgacaaagcctagtgacactgtccattgtaaaattccacatcatattagtattaaacatatacatgtagtttcctgaacacatgtagtatcaaacacacttcgtggcttcttcctcgaaacctgcggccgctcattaattaagtcatctagttgaaggatcgctatcaactttgtatagaaaagttgggccgaattcgagctcggtacggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatgatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggataaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgggttaccgaattcgagctcggtaccctgggatccgatatcgatgggccctggccgaagcttggtcacccggtccgggcctagaaggccgatctcccgggcacccagctttcttgtacaaagtggccgttaacggatcggccagaatggcccggaccgggttaccgaattcgagctcggtaccctgggatccgatatcgatgggccctggccgaagcttggtcacccggtccgggcctagaaggccagcttcggccgccccgggcaactttattatacaaagttgatagatcctcatgtcttcatcgtaagcttaaacaggccagaatggcctctggattcagcggcctagaaggccgaagtacttggtcttcctagtcgagtagatcacattcaagcttggtcacccggtccgtcaatattctgattccgatgacttcgtaggttcctagctcaagccgctcgtgtccaagcgtcacttacgattagctaatgattacggcatctaggaccgactagtggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 26 - DNA, 25930 bp, Artificial Sequence
  RV036690
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatctgcggttaccgaattcgagctcggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtaagtttctgcttctacctttgatatatatataataattatcattaattagtagtaatataatatttcaaatatttttttcaaaataaaagaatgtagtatatagcaattgcttttctgtagtttataacttcgtatagcatacattatacgaagttatacttttctaatatatgaccaaaatttgttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccgggatctgagtcgaaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagatcgatgggccctggccgaagcttggtcacccggtccgggcctagaaggccagcttcaagtttgtaccctggagcttgccgagtgccatccttggacactcgataaagtatattttattttttttattttgccaaccaaactttttgtggtatgttcctacactatgtagatctacatgtaccattttggcacaattacatatttacaaaaatgttttctataaatattagatttagttcgtttatttgaatttcttcggaaaattcacatttaaactgcaagtcactcgaaacatggaaaaccgtgcatgcaaaataaatgatatgcatgttatctagcacaagttacgaccgatttcagaagcagaccagaatcttcaagcaccatgctcactaaacatgaccgtgaacttgttatctagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtactcgacaaagaagccgttgtcgatgtactgttcgtcgagatctctttgtcgagtgtcacactaggcaaagtctttacggagtgtttttcaggctttgacactcggcaaagcgctcgattccagtagtgacagtaatttgcatcaaaaatagctgagagatttaggccccgtttcaatctcacgggataaagtttagcttcctgctaaactttagctatatgaattgaagtgctaaagtttagtttcaattaccaccattagctctcctgtttagattacaaatggctaaaagtagctaaaaaatagctgctaaagtttatctcgcgagattgaaacagggccttaaaatgagtcaactaatagaccaactaattattagctattagtcgttagcttctttaatctaagctaaaaccaactaatagcttatttgttgaattacaattagctcaacggaattctctgtttttctaaaaaaaaactgcccctctcttacagcaaattgtccgctgcccgtcgtccagatacaatgaacgtacctagtaggaactcttttacacgctcggtcgctcgccgcggatcggagtccccggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaaggatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgagctagacccagctttcttgtacaaagtggccgttaacggatccagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcaagctgttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccatttcaaatatttttttcaaaataaaagaatgtagtatatagcaattgcttttctgtagtttataacttcgtatagcatacattatacgaagttatacttttctaatatatgaccaaaatttgttgatgtgcaggtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgatgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacataaagctttccactggttgccatatatgatttgggcatttcactttgatcttaatgggccttgtaaagcccaagactcatgattatctttagttgatgctcttaattaggtgtgggcaaataattcaaactgtatgtacccgaccaaaaccaaagcaaaaataatcgaaccaaaccgaaaatttaaaaataaccgaatgaaaactaaatcctataactgaaagaactgaaaccgaatcaaaatatttaatgtaaccaaaaatatccgaaatataattatattgtcaaaaatattaataatttctagattaaataattaaaaatacttaaaaatttatataaaatagtaaaaatactcgaaaataaccacaaatattcaaaaacaaccgaaatatcccaaaatattcaaagcaaaataaccgaatggataccaaattttaaaaccgaaaaaactggaacaaaaccaaaatcgaaccaaaatttcaaaaatcgaataaatactaaactttagaacaaaaaaaaacgataaccgaatgtatacgaaccaaagccgaattagataaccgaacgtccaggactactcttaatctttccgccacttatgatttgggctattactttgtttataatgagccttttcaagctcaagttcatgattgtccgtgagatgagaaactgacttgttggattcgaaaccctagctagtattggttaatacttaatacataaatgacctgcattgacatcatcatccaagaaaataaaaattgtatgcttgagatatttagttttcctagctaggttttctttattttagtaccgaatctttaggtgtgccacgttaatttagacccattttttcatacttaccaactgagtctagtttaatcatgactataatcgtataaaatgattcagtcgacgtcattgcgaacgtatataaaatcatccaaattgacgtcattccaaagaggtaagcatgcttatctaagagtccgagcatactaaacaagacgacattttatttgcactccaaatcaaattttgtattgcctaaagaaaaacaatcaaactcaagtttcttaaaattaatttcattcaaactaatcactttcaatatctcacatattattcatgccatttctatttgtctaaacatgatttaaaaaaaaaagtaaaatacaaagattactatgcaaaaactctataaaaaaaaattcaaatttcttatttatttgtgacatcaaattttcaaaataatttttttaattatcggttgatccggtcagtcgataaaaacataaactttcagcgaccgttaaaactttcctactaccgatttagagaaaatcttagcttgaaacgtaattgtaacctgccttcatgcaagtcgcaagatatgtcatcctaagttgtatatgttttctcaaaagatgtatttacttgagaaaatacgtttcaacgttgatggacaaccaattaagaatcaagcacctttcgtaatcaatttaggcttatcgtctaaggtatactgatttacgacagttgactagacttataaggaacaaaataatagaatagtttctaaacacttcacctaatcatagagactaagatggtaattcgtaaacgacaaagcctagtgacactgtccattgtaaaattccacatcatattagtattaaacatatacatgtagtttcctgaacacatgtagtatcaaacacacttcgtggcttcttcctcgaaacctgcggccgctcattaattaagtcatctagttgaaggatcgctatcaactttgtatagaaaagttgggccgaattcgagctcggtacggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatggcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcctcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggataaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgggttaccgaattcgagctcggtaccctgggatccgatatcgatgggccctggccgaagcttggtcacccggtccgggcctagaaggccgatctcccgggcacccagctttcttgtacaaagtggccgttaacggatcggccagaatggcccggaccgggttaccgaattcgagctcggtaccctgggatccgatatcgatgggccctggccgaagcttggtcacccggtccgggcctagaaggccagcttcggccgccccgggcaactttattatacaaagttgatagatcctcatgtcttcatcgtaagcttaaacaggccagaatggcctctggattcagcggcctagaaggccgaagtacttggtcttcctagtcgagtagatcacattcaagcttggtcacccggtccgtcaatattctgattccgatgacttcgtaggttcctagctcaagccgctcgtgtccaagcgtcacttacgattagctaatgattacggcatctaggaccgactagtggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 27 - DNA, 25417 bp, Artificial Sequence
  RV036688
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatctgcggttaccgaattcgagctcggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtaagtttctgcttctacctttgatatatatataataattatcattaattagtagtaatataatatttcaaatatttttttcaaaataaaagaatgtagtatatagcaattgcttttctgtagtttataacttcgtatagcatacattatacgaagttatacttttctaatatatgaccaaaatttgttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccgggatctgagtcgaaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagatcgatgggccctggccgaagcttggtcacccggtccgggcctagaaggccagcttcaagtttgtaccctggagcttgccgagtgccatccttggacactcgataaagtatattttattttttttattttgccaaccaaactttttgtggtatgttcctacactatgtagatctacatgtaccattttggcacaattacatatttacaaaaatgttttctataaatattagatttagttcgtttatttgaatttcttcggaaaattcacatttaaactgcaagtcactcgaaacatggaaaaccgtgcatgcaaaataaatgatatgcatgttatctagcacaagttacgaccgatttcagaagcagaccagaatcttcaagcaccatgctcactaaacatgaccgtgaacttgttatctagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtactcgacaaagaagccgttgtcgatgtactgttcgtcgagatctctttgtcgagtgtcacactaggcaaagtctttacggagtgtttttcaggctttgacactcggcaaagcgctcgattccagtagtgacagtaatttgcatcaaaaatagctgagagatttaggccccgtttcaatctcacgggataaagtttagcttcctgctaaactttagctatatgaattgaagtgctaaagtttagtttcaattaccaccattagctctcctgtttagattacaaatggctaaaagtagctaaaaaatagctgctaaagtttatctcgcgagattgaaacagggccttaaaatgagtcaactaatagaccaactaattattagctattagtcgttagcttctttaatctaagctaaaaccaactaatagcttatttgttgaattacaattagctcaacggaattctctgtttttctaaaaaaaaactgcccctctcttacagcaaattgtccgctgcccgtcgtccagatacaatgaacgtacctagtaggaactcttttacacgctcggtcgctcgccgcggatcggagtccccggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaaggatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgagctagacccagctttcttgtacaaagtggccgttaacggatccagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcaagctgttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccatttcaaatatttttttcaaaataaaagaatgtagtatatagcaattgcttttctgtagtttataacttcgtatagcatacattatacgaagttatacttttctaatatatgaccaaaatttgttgatgtgcaggtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgatgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacataaagctttccactggttgccatatatgatttgggcatttcactttgatcttaatgggccttgtaaagcccaagactcatgattatctttagttgatgctcttaattaggtgtgggcaaataattcaaactgtatgtacccgaccaaaaccaaagcaaaaataatcgaaccaaaccgaaaatttaaaaataaccgaatgaaaactaaatcctataactgaaagaactgaaaccgaatcaaaatatttaatgtaaccaaaaatatccgaaatataattatattgtcaaaaatattaataatttctagattaaataattaaaaatacttaaaaatttatataaaatagtaaaaatactcgaaaataaccacaaatattcaaaaacaaccgaaatatcccaaaatattcaaagcaaaataaccgaatggataccaaattttaaaaccgaaaaaactggaacaaaaccaaaatcgaaccaaaatttcaaaaatcgaataaatactaaactttagaacaaaaaaaaacgataaccgaatgtatacgaaccaaagccgaattagataaccgaacgtccaggactactcttaatctttccgccacttatgatttgggctattactttgtttataatgagccttttcaagctcaagttcatgattgtccgtgagatgagaaactgacttgttggattcgaaaccctagctagtattggttaatacttaatacataaatgacctgcattgacatcatcatccaagaaaataaaaattgtatgcttgagatatttagttttcctagctaggttttctttattttagtaccgaatctttaggtgtgccacgttaatttagacccattttttcatacttaccaactgagtctagtttaatcatgactataatcgtataaaatgattcagtcgacgtcattgcgaacgtatataaaatcatccaaattgacgtcattccaaagaggtaagcatgcttatctaagagtccgagcatactaaacaagacgacattttatttgcactccaaatcaaattttgtattgcctaaagaaaaacaatcaaactcaagtttcttaaaattaatttcattcaaactaatcactttcaatatctcacatattattcatgccatttctatttgtctaaacatgatttaaaaaaaaaagtaaaatacaaagattactatgcaaaaactctataaaaaaaaattcaaatttcttatttatttgtgacatcaaattttcaaaataatttttttaattatcggttgatccggtcagtcgataaaaacataaactttcagcgaccgttaaaactttcctactaccgatttagagaaaatcttagcttgaaacgtaattgtaacctgccttcatgcaagtcgcaagatatgtcatcctaagttgtatatgttttctcaaaagatgtatttacttgagaaaatacgtttcaacgttgatggacaaccaattaagaatcaagcacctttcgtaatcaatttaggcttatcgtctaaggtatactgatttacgacagttgactagacttataaggaacaaaataatagaatagtttctaaacacttcacctaatcatagagactaagatggtaattcgtaaacgacaaagcctagtgacactgtccattgtaaaattccacatcatattagtattaaacatatacatgtagtttcctgaacacatgtagtatcaaacacacttcgtggcttcttcctcgaaacctgcggccgctcattaattaagtcatctagttgaaggatcgctatcaactttgtatagaaaagttgggccgaattcgagctcggtacggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggataaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgggttaccgaattcgagctcggtaccctgggatccgatatcgatgggccctggccgaagcttggtcacccggtccgggcctagaaggccgatctcccgggcacccagctttcttgtacaaagtggccgttaacggatcggccagaatggcccggaccgggttaccgaattcgagctcggtaccctgggatccgatatcgatgggccctggccgaagcttggtcacccggtccgggcctagaaggccagcttcggccgccccgggcaactttattatacaaagttgatagatcctcatgtcttcatcgtaagcttaaacaggccagaatggcctctggattcagcggcctagaaggccgaagtacttggtcttcctagtcgagtagatcacattcaagcttggtcacccggtccgtcaatattctgattccgatgacttcgtaggttcctagctcaagccgctcgtgtccaagcgtcacttacgattagctaatgattacggcatctaggaccgactagtggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 28 - DNA, 25402 bp, Artificial Sequence
  RV036694
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatctgcggttaccgaattcgagctcggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtaagtttctgcttctacctttgatatatatataataattatcattaattagtagtaatataatatttcaaatatttttttcaaaataaaagaatgtagtatatagcaattgcttttctgtagtttataacttcgtatagcatacattatacgaagttatacttttctaatatatgaccaaaatttgttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccgggatctgagtcgaaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagatcgatgggccctggccgaagcttggtcacccggtccgggcctagaaggccagcttcaagtttgtaccctggagcttgccgagtgccatccttggacactcgataaagtatattttattttttttattttgccaaccaaactttttgtggtatgttcctacactatgtagatctacatgtaccattttggcacaattacatatttacaaaaatgttttctataaatattagatttagttcgtttatttgaatttcttcggaaaattcacatttaaactgcaagtcactcgaaacatggaaaaccgtgcatgcaaaataaatgatatgcatgttatctagcacaagttacgaccgatttcagaagcagaccagaatcttcaagcaccatgctcactaaacatgaccgtgaacttgttatctagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtactcgacaaagaagccgttgtcgatgtactgttcgtcgagatctctttgtcgagtgtcacactaggcaaagtctttacggagtgtttttcaggctttgacactcggcaaagcgctcgattccagtagtgacagtaatttgcatcaaaaatagctgagagatttaggccccgtttcaatctcacgggataaagtttagcttcctgctaaactttagctatatgaattgaagtgctaaagtttagtttcaattaccaccattagctctcctgtttagattacaaatggctaaaagtagctaaaaaatagctgctaaagtttatctcgcgagattgaaacagggccttaaaatgagtcaactaatagaccaactaattattagctattagtcgttagcttctttaatctaagctaaaaccaactaatagcttatttgttgaattacaattagctcaacggaattctctgtttttctaaaaaaaaactgcccctctcttacagcaaattgtccgctgcccgtcgtccagatacaatgaacgtacctagtaggaactcttttacacgctcggtcgctcgccgcggatcggagtccccggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaaggatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgagctagacccagctttcttgtacaaagtggccgttaacggatccagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcaagctgttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccatttcaaatatttttttcaaaataaaagaatgtagtatatagcaattgcttttctgtagtttataacttcgtatagcatacattatacgaagttatacttttctaatatatgaccaaaatttgttgatgtgcaggtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgatgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacataaagctttccactggttgccatatatgatttgggcatttcactttgatcttaatgggccttgtaaagcccaagactcatgattatctttagttgatgctcttaattaggtgtgggcaaataattcaaactgtatgtacccgaccaaaaccaaagcaaaaataatcgaaccaaaccgaaaatttaaaaataaccgaatgaaaactaaatcctataactgaaagaactgaaaccgaatcaaaatatttaatgtaaccaaaaatatccgaaatataattatattgtcaaaaatattaataatttctagattaaataattaaaaatacttaaaaatttatataaaatagtaaaaatactcgaaaataaccacaaatattcaaaaacaaccgaaatatcccaaaatattcaaagcaaaataaccgaatggataccaaattttaaaaccgaaaaaactggaacaaaaccaaaatcgaaccaaaatttcaaaaatcgaataaatactaaactttagaacaaaaaaaaacgataaccgaatgtatacgaaccaaagccgaattagataaccgaacgtccaggactactcttaatctttccgccacttatgatttgggctattactttgtttataatgagccttttcaagctcaagttcatgattgtccgtgagatgagaaactgacttgttggattcgaaaccctagctagtattggttaatacttaatacataaatgacctgcattgacatcatcatccaagaaaataaaaattgtatgcttgagatatttagttttcctagctaggttttctttattttagtaccgaatctttaggtgtgccacgttaatttagacccattttttcatacttaccaactgagtctagtttaatcatgactataatcgtataaaatgattcagtcgacgtcattgcgaacgtatataaaatcatccaaattgacgtcattccaaagaggtaagcatgcttatctaagagtccgagcatactaaacaagacgacattttatttgcactccaaatcaaattttgtattgcctaaagaaaaacaatcaaactcaagtttcttaaaattaatttcattcaaactaatcactttcaatatctcacatattattcatgccatttctatttgtctaaacatgatttaaaaaaaaaagtaaaatacaaagattactatgcaaaaactctataaaaaaaaattcaaatttcttatttatttgtgacatcaaattttcaaaataatttttttaattatcggttgatccggtcagtcgataaaaacataaactttcagcgaccgttaaaactttcctactaccgatttagagaaaatcttagcttgaaacgtaattgtaacctgccttcatgcaagtcgcaagatatgtcatcctaagttgtatatgttttctcaaaagatgtatttacttgagaaaatacgtttcaacgttgatggacaaccaattaagaatcaagcacctttcgtaatcaatttaggcttatcgtctaaggtatactgatttacgacagttgactagacttataaggaacaaaataatagaatagtttctaaacacttcacctaatcatagagactaagatggtaattcgtaaacgacaaagcctagtgacactgtccattgtaaaattccacatcatattagtattaaacatatacatgtagtttcctgaacacatgtagtatcaaacacacttcgtggcttcttcctcgaaacctgcggccgctcattaattaagtcatctagttgaaggatcgctatcaactttgtatagaaaagttgggccgaattcgagctcggtacggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatgatcgggctgtccatgattaagaactggctgcggagccaaccggcgcccggtggaggcggcagcggtggcggaggctccggaggcggtggcgacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggataaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgggttaccgaattcgagctcggtaccctgggatccgatatcgatgggccctggccgaagcttggtcacccggtccgggcctagaaggccgatctcccgggcacccagctttcttgtacaaagtggccgttaacggatcggccagaatggcccggaccgggttaccgaattcgagctcggtaccctgggatccgatatcgatgggccctggccgaagcttggtcacccggtccgggcctagaaggccagcttcggccgccccgggcaactttattatacaaagttgatagatcctcatgtcttcatcgtaagcttaaacaggccagaatggcctctggattcagcggcctagaaggccgaagtacttggtcttcctagtcgagtagatcacattcaagcttggtcacccggtccgtcaatattctgattccgatgacttcgtaggttcctagctcaagccgctcgtgtccaagcgtcacttacgattagctaatgattacggcatctaggaccgactagtggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 29 - DNA, 25384 bp, Artificial Sequence
  RV036693
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatctgcggttaccgaattcgagctcggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtaagtttctgcttctacctttgatatatatataataattatcattaattagtagtaatataatatttcaaatatttttttcaaaataaaagaatgtagtatatagcaattgcttttctgtagtttataacttcgtatagcatacattatacgaagttatacttttctaatatatgaccaaaatttgttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccgggatctgagtcgaaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagatcgatgggccctggccgaagcttggtcacccggtccgggcctagaaggccagcttcaagtttgtaccctggagcttgccgagtgccatccttggacactcgataaagtatattttattttttttattttgccaaccaaactttttgtggtatgttcctacactatgtagatctacatgtaccattttggcacaattacatatttacaaaaatgttttctataaatattagatttagttcgtttatttgaatttcttcggaaaattcacatttaaactgcaagtcactcgaaacatggaaaaccgtgcatgcaaaataaatgatatgcatgttatctagcacaagttacgaccgatttcagaagcagaccagaatcttcaagcaccatgctcactaaacatgaccgtgaacttgttatctagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtactcgacaaagaagccgttgtcgatgtactgttcgtcgagatctctttgtcgagtgtcacactaggcaaagtctttacggagtgtttttcaggctttgacactcggcaaagcgctcgattccagtagtgacagtaatttgcatcaaaaatagctgagagatttaggccccgtttcaatctcacgggataaagtttagcttcctgctaaactttagctatatgaattgaagtgctaaagtttagtttcaattaccaccattagctctcctgtttagattacaaatggctaaaagtagctaaaaaatagctgctaaagtttatctcgcgagattgaaacagggccttaaaatgagtcaactaatagaccaactaattattagctattagtcgttagcttctttaatctaagctaaaaccaactaatagcttatttgttgaattacaattagctcaacggaattctctgtttttctaaaaaaaaactgcccctctcttacagcaaattgtccgctgcccgtcgtccagatacaatgaacgtacctagtaggaactcttttacacgctcggtcgctcgccgcggatcggagtccccggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaaggatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgagctagacccagctttcttgtacaaagtggccgttaacggatccagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcaagctgttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccatttcaaatatttttttcaaaataaaagaatgtagtatatagcaattgcttttctgtagtttataacttcgtatagcatacattatacgaagttatacttttctaatatatgaccaaaatttgttgatgtgcaggtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgatgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacataaagctttccactggttgccatatatgatttgggcatttcactttgatcttaatgggccttgtaaagcccaagactcatgattatctttagttgatgctcttaattaggtgtgggcaaataattcaaactgtatgtacccgaccaaaaccaaagcaaaaataatcgaaccaaaccgaaaatttaaaaataaccgaatgaaaactaaatcctataactgaaagaactgaaaccgaatcaaaatatttaatgtaaccaaaaatatccgaaatataattatattgtcaaaaatattaataatttctagattaaataattaaaaatacttaaaaatttatataaaatagtaaaaatactcgaaaataaccacaaatattcaaaaacaaccgaaatatcccaaaatattcaaagcaaaataaccgaatggataccaaattttaaaaccgaaaaaactggaacaaaaccaaaatcgaaccaaaatttcaaaaatcgaataaatactaaactttagaacaaaaaaaaacgataaccgaatgtatacgaaccaaagccgaattagataaccgaacgtccaggactactcttaatctttccgccacttatgatttgggctattactttgtttataatgagccttttcaagctcaagttcatgattgtccgtgagatgagaaactgacttgttggattcgaaaccctagctagtattggttaatacttaatacataaatgacctgcattgacatcatcatccaagaaaataaaaattgtatgcttgagatatttagttttcctagctaggttttctttattttagtaccgaatctttaggtgtgccacgttaatttagacccattttttcatacttaccaactgagtctagtttaatcatgactataatcgtataaaatgattcagtcgacgtcattgcgaacgtatataaaatcatccaaattgacgtcattccaaagaggtaagcatgcttatctaagagtccgagcatactaaacaagacgacattttatttgcactccaaatcaaattttgtattgcctaaagaaaaacaatcaaactcaagtttcttaaaattaatttcattcaaactaatcactttcaatatctcacatattattcatgccatttctatttgtctaaacatgatttaaaaaaaaaagtaaaatacaaagattactatgcaaaaactctataaaaaaaaattcaaatttcttatttatttgtgacatcaaattttcaaaataatttttttaattatcggttgatccggtcagtcgataaaaacataaactttcagcgaccgttaaaactttcctactaccgatttagagaaaatcttagcttgaaacgtaattgtaacctgccttcatgcaagtcgcaagatatgtcatcctaagttgtatatgttttctcaaaagatgtatttacttgagaaaatacgtttcaacgttgatggacaaccaattaagaatcaagcacctttcgtaatcaatttaggcttatcgtctaaggtatactgatttacgacagttgactagacttataaggaacaaaataatagaatagtttctaaacacttcacctaatcatagagactaagatggtaattcgtaaacgacaaagcctagtgacactgtccattgtaaaattccacatcatattagtattaaacatatacatgtagtttcctgaacacatgtagtatcaaacacacttcgtggcttcttcctcgaaacctgcggccgctcattaattaagtcatctagttgaaggatcgctatcaactttgtatagaaaagttgggccgaattcgagctcggtacggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatggcggagccgaagctggaggacttcctcggcggtggaggcggcagcggtggcggaggctccggaggcggtggcgacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggataaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgggttaccgaattcgagctcggtaccctgggatccgatatcgatgggccctggccgaagcttggtcacccggtccgggcctagaaggccgatctcccgggcacccagctttcttgtacaaagtggccgttaacggatcggccagaatggcccggaccgggttaccgaattcgagctcggtaccctgggatccgatatcgatgggccctggccgaagcttggtcacccggtccgggcctagaaggccagcttcggccgccccgggcaactttattatacaaagttgatagatcctcatgtcttcatcgtaagcttaaacaggccagaatggcctctggattcagcggcctagaaggccgaagtacttggtcttcctagtcgagtagatcacattcaagcttggtcacccggtccgtcaatattctgattccgatgacttcgtaggttcctagctcaagccgctcgtgtccaagcgtcacttacgattagctaatgattacggcatctaggaccgactagtggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 30 - DNA, 25474 bp, Artificial Sequence
  RV036695
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatctgcggttaccgaattcgagctcggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtaagtttctgcttctacctttgatatatatataataattatcattaattagtagtaatataatatttcaaatatttttttcaaaataaaagaatgtagtatatagcaattgcttttctgtagtttataacttcgtatagcatacattatacgaagttatacttttctaatatatgaccaaaatttgttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccgggatctgagtcgaaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagatcgatgggccctggccgaagcttggtcacccggtccgggcctagaaggccagcttcaagtttgtaccctggagcttgccgagtgccatccttggacactcgataaagtatattttattttttttattttgccaaccaaactttttgtggtatgttcctacactatgtagatctacatgtaccattttggcacaattacatatttacaaaaatgttttctataaatattagatttagttcgtttatttgaatttcttcggaaaattcacatttaaactgcaagtcactcgaaacatggaaaaccgtgcatgcaaaataaatgatatgcatgttatctagcacaagttacgaccgatttcagaagcagaccagaatcttcaagcaccatgctcactaaacatgaccgtgaacttgttatctagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtactcgacaaagaagccgttgtcgatgtactgttcgtcgagatctctttgtcgagtgtcacactaggcaaagtctttacggagtgtttttcaggctttgacactcggcaaagcgctcgattccagtagtgacagtaatttgcatcaaaaatagctgagagatttaggccccgtttcaatctcacgggataaagtttagcttcctgctaaactttagctatatgaattgaagtgctaaagtttagtttcaattaccaccattagctctcctgtttagattacaaatggctaaaagtagctaaaaaatagctgctaaagtttatctcgcgagattgaaacagggccttaaaatgagtcaactaatagaccaactaattattagctattagtcgttagcttctttaatctaagctaaaaccaactaatagcttatttgttgaattacaattagctcaacggaattctctgtttttctaaaaaaaaactgcccctctcttacagcaaattgtccgctgcccgtcgtccagatacaatgaacgtacctagtaggaactcttttacacgctcggtcgctcgccgcggatcggagtccccggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaaggatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgagctagacccagctttcttgtacaaagtggccgttaacggatccagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcaagctgttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccatttcaaatatttttttcaaaataaaagaatgtagtatatagcaattgcttttctgtagtttataacttcgtatagcatacattatacgaagttatacttttctaatatatgaccaaaatttgttgatgtgcaggtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgatgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacataaagctttccactggttgccatatatgatttgggcatttcactttgatcttaatgggccttgtaaagcccaagactcatgattatctttagttgatgctcttaattaggtgtgggcaaataattcaaactgtatgtacccgaccaaaaccaaagcaaaaataatcgaaccaaaccgaaaatttaaaaataaccgaatgaaaactaaatcctataactgaaagaactgaaaccgaatcaaaatatttaatgtaaccaaaaatatccgaaatataattatattgtcaaaaatattaataatttctagattaaataattaaaaatacttaaaaatttatataaaatagtaaaaatactcgaaaataaccacaaatattcaaaaacaaccgaaatatcccaaaatattcaaagcaaaataaccgaatggataccaaattttaaaaccgaaaaaactggaacaaaaccaaaatcgaaccaaaatttcaaaaatcgaataaatactaaactttagaacaaaaaaaaacgataaccgaatgtatacgaaccaaagccgaattagataaccgaacgtccaggactactcttaatctttccgccacttatgatttgggctattactttgtttataatgagccttttcaagctcaagttcatgattgtccgtgagatgagaaactgacttgttggattcgaaaccctagctagtattggttaatacttaatacataaatgacctgcattgacatcatcatccaagaaaataaaaattgtatgcttgagatatttagttttcctagctaggttttctttattttagtaccgaatctttaggtgtgccacgttaatttagacccattttttcatacttaccaactgagtctagtttaatcatgactataatcgtataaaatgattcagtcgacgtcattgcgaacgtatataaaatcatccaaattgacgtcattccaaagaggtaagcatgcttatctaagagtccgagcatactaaacaagacgacattttatttgcactccaaatcaaattttgtattgcctaaagaaaaacaatcaaactcaagtttcttaaaattaatttcattcaaactaatcactttcaatatctcacatattattcatgccatttctatttgtctaaacatgatttaaaaaaaaaagtaaaatacaaagattactatgcaaaaactctataaaaaaaaattcaaatttcttatttatttgtgacatcaaattttcaaaataatttttttaattatcggttgatccggtcagtcgataaaaacataaactttcagcgaccgttaaaactttcctactaccgatttagagaaaatcttagcttgaaacgtaattgtaacctgccttcatgcaagtcgcaagatatgtcatcctaagttgtatatgttttctcaaaagatgtatttacttgagaaaatacgtttcaacgttgatggacaaccaattaagaatcaagcacctttcgtaatcaatttaggcttatcgtctaaggtatactgatttacgacagttgactagacttataaggaacaaaataatagaatagtttctaaacacttcacctaatcatagagactaagatggtaattcgtaaacgacaaagcctagtgacactgtccattgtaaaattccacatcatattagtattaaacatatacatgtagtttcctgaacacatgtagtatcaaacacacttcgtggcttcttcctcgaaacctgcggccgctcattaattaagtcatctagttgaaggatcgctatcaactttgtatagaaaagttgggccgaattcgagctcggtacggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatggcggagccgaagctggaggacttcctcggcggtggaggcggcagcggtggcggaggctccggaggcggtggcatcgggctgtccatgattaagaactggctgcggagccaaccggcgcccggtggaggcggcagcggtggcggaggctccggaggcggtggcgacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggataaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgggttaccgaattcgagctcggtaccctgggatccgatatcgatgggccctggccgaagcttggtcacccggtccgggcctagaaggccgatctcccgggcacccagctttcttgtacaaagtggccgttaacggatcggccagaatggcccggaccgggttaccgaattcgagctcggtaccctgggatccgatatcgatgggccctggccgaagcttggtcacccggtccgggcctagaaggccagcttcggccgccccgggcaactttattatacaaagttgatagatcctcatgtcttcatcgtaagcttaaacaggccagaatggcctctggattcagcggcctagaaggccgaagtacttggtcttcctagtcgagtagatcacattcaagcttggtcacccggtccgtcaatattctgattccgatgacttcgtaggttcctagctcaagccgctcgtgtccaagcgtcacttacgattagctaatgattacggcatctaggaccgactagtggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 31 - DNA, 1299 bp, Panicum virgatum
cctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaaga

SEQ ID NO: 32 - DNA, 100 bp, Panicum virgatum
gccgcaggtcgtttggcgttccatgagcagacactgcagtgagtggatagcaatcaatagcgatgctctttggccttccatgaaacgcacgcactcatgt

SEQ ID NO: 33 - DNA, 163 bp, Panicum virgatum
cgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagca

SEQ ID NO: 34 - DNA, 1399 bp, Panicum virgatum
cctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgt

SEQ ID NO: 35 - DNA, 48 bp, Zea mays
atcgggctgtccatgattaagaactggctgcggagccaaccggcgccc

SEQ ID NO: 36 - protein, 16 aa, Zea mays
IGLSMIKNWLRSQPAP

SEQ ID NO: 37 - DNA, 30 bp, Zea mays
gcggagccgaagctggaggacttcctcggc

SEQ ID NO: 38 - protein, 10 aa, Zea mays
AEPKLEDFLG

SEQ ID NO: 39 - DNA, 17 bp, Zea mays
tgacgtaaggtatgacg

SEQ ID NO: 40 - DNA, 14 bp, Zea mays
cgtaaggtatgacg

SEQ ID NO: 41 - DNA, 22 bp, Zea mays
aacaacgtaagcgcttacgcac

SEQ ID NO: 42 - DNA, 16 bp, Zea mays
acgtaagcgcttacgc

SEQ ID NO: 43 - DNA, 14 bp, Zea mays
cgtaagcgcttacg

SEQ ID NO: 44 - DNA, 14 bp, Zea mays
cgtaaacaaatacg

SEQ ID NO: 45 - DNA, 14 bp, Zea mays
cgtaaacgcttacg

SEQ ID NO: 46 - DNA, 17 bp, Zea mays
tgacgtatggtatgacg

SEQ ID NO: 47 - DNA, 14 bp, Zea mays
cgtaaggtcttacg

SEQ ID NO: 48 - DNA, 14 bp, Zea mays
cgtaagtccttacg

SEQ ID NO: 49 - DNA, 14 bp, Zea mays
cgtaagtgcttacg

SEQ ID NO: 50 - DNA, 14 bp, Zea mays
cgtaaggccttacg

SEQ ID NO: 51 - DNA, 14 bp, Zea mays
cgtaagaccttacg

SEQ ID NO: 52 - DNA, 14 bp, Zea mays
cgtaaggacttacg

SEQ ID NO: 53 - DNA, 14 bp, Zea mays
cgtaagcacttacg

SEQ ID NO: 54 - DNA, 14 bp, Zea mays
cgtaagggcttacg

SEQ ID NO: 55 - DNA, 14 bp, Zea mays
cgtaagcccttacg

SEQ ID NO: 56 - DNA, 14 bp, Zea mays
cgtaagtacttacg

SEQ ID NO: 57 - DNA, 14 bp, Zea mays
cgtaagatcttacg

SEQ ID NO: 58 - DNA, 16 bp, Zea mays
gcgtaagcgcttacgc

SEQ ID NO: 59 - DNA, 16 bp, Zea mays
aagtaagcgcttactt

SEQ ID NO: 60 - DNA, 16 bp, Zea mays
acttaagcgcttaagt

SEQ ID NO: 61 - DNA, 16 bp, Zea mays
acggaagcgcttccgt

SEQ ID NO: 62 - DNA, 16 bp, Zea mays
acgtgagcgctcacgt

SEQ ID NO: 63 - DNA, 16 bp, Zea mays
acgtaggcgcctacgt

SEQ ID NO: 64 - DNA, 16 bp, Zea mays
acgtaatcgattacgt

SEQ ID NO: 65 - DNA, 16 bp, Zea mays
gatcggtataccgatc

SEQ ID NO: 66 - DNA, 16 bp, Zea mays
acgtaagcgcttacgt

SEQ ID NO: 67 - DNA, 20 bp, Zea mays
acaacgtaagcgcttacgca

SEQ ID NO: 68 - DNA, 18 bp, Zea mays
caacgtaagcgcttacgc

SEQ ID NO: 69 - DNA, 15 bp, Zea mays
acgtaagcgcttacg

SEQ ID NO: 70 - DNA, 15 bp, Zea mays
cgtaagcgcttacgc

SEQ ID NO: 71 - DNA, 13 bp, Zea mays
cgtaagcgcttac

SEQ ID NO: 72 - DNA, 13 bp, Zea mays
gtaagcgcttacg

SEQ ID NO: 73 - DNA, 10 bp, Zea mays
taagcgctta

SEQ ID NO: 74 - DNA, 21 bp, Zea mays
ctgacgtaagggatgacgcac

SEQ ID NO: 75 - DNA, 16 bp, Zea mays
gacgtaaggtatgacg

SEQ ID NO: 76 - DNA, 15 bp, Zea mays
acgtaaggtatgacg

SEQ ID NO: 77 - DNA, 13 bp, Zea mays
gtaaggtatgacg

SEQ ID NO: 78 - DNA, 12 bp, Zea mays
taaggtatgacg

SEQ ID NO: 79 - DNA, 21 bp, Zea mays
ctgacgtaagcgcttacgtac

SEQ ID NO: 80 - DNA, 21 bp, Zea mays
ctgacgtaagcgctgacgtac

SEQ ID NO: 81 - DNA, 21 bp, Zea mays
ctgacgtaagcgctgacgcac

SEQ ID NO: 82 - DNA, 16 bp, Zea mays
acgtaagcgattacgt

SEQ ID NO: 83 - DNA, 21 bp, Zea mays
ctgacgtaagcgattacgcac

SEQ ID NO: 84 - DNA, 21 bp, Zea mays
ctgacgtaagcgattacgtac

SEQ ID NO: 85 - DNA, 21 bp, Zea mays
ctgacgtaagggattacgtac

SEQ ID NO: 86 - DNA, 22 bp, Zea mays
aatgacgtaagcgcttacgcac

SEQ ID NO: 87 - DNA, 22 bp, Zea mays
aatgacgtaagcgctgacgcac

SEQ ID NO: 88 - DNA, 12 bp, Zea mays
cgtaaggtatga

SEQ ID NO: 89 - DNA, 12 bp, Zea mays
gtaaggtatgac

SEQ ID NO: 90 - DNA, 12 bp, Zea mays
gacgtaaggtat

SEQ ID NO: 91 - DNA, 13 bp, Zea mays
acgtaaggtatga

SEQ ID NO: 92 - DNA, 13 bp, Zea mays
cgtaaggtatgac

SEQ ID NO: 93 - DNA, 13 bp, Zea mays
gacgtaaggtatg

SEQ ID NO: 94 - DNA, 14 bp, Zea mays
acgtaaggtatgac

SEQ ID NO: 95 - DNA, 14 bp, Zea mays
gacgtaaggtatga

SEQ ID NO: 96 - DNA, 15 bp, Zea mays
gacgtaaggtatgac

SEQ ID NO: 97 - DNA, 11 bp, Zea mays
taagcgcttac

SEQ ID NO: 98 - DNA, 12 bp, Zea mays
gtaagcgcttac

SEQ ID NO: 99 - DNA, 12 bp, Zea mays
taagcgcttacg

SEQ ID NO: 100 - DNA, 14 bp, Zea mays
gtaagcgcttacgc

SEQ ID NO: 101 - DNA, 16 bp, Zea mays
aacgtaagcgcttacg

SEQ ID NO: 102 - DNA, 16 bp, Zea mays
acgtaagcgcttacga

SEQ ID NO: 103 - DNA, 16 bp, Zea mays
acgtaagcgcttacgg

SEQ ID NO: 104 - DNA, 436 bp, Cauliflower mosaic virus
catggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgat

SEQ ID NO: 105 - DNA, 280 bp, Citrus Yellow Mosaic Virus
caattatggagcgtgatggacccccccgcaataatccaaagtttggtgtgcttttagtagtgcgtctttatggaccactactttattgtaataatcgatgctttttgtagtgcgctcttcgtgcgctctactttatgcttttgcttttgtaagtgcgctgtaagtgcgcctgtctttcttcagatgcttatcctttaagcatcttttgctttttgcgtggcatcctttagttcacaatttaaagaatgacgatggggcccaagatgtgcacccggttctc

SEQ ID NO: 106 - DNA, 293 bp, Banana Streak Virus
gccagaagatagaagatatcctggacctgcaagatgtcagcaatgacgattgaaagattcccaggatagccggcggacgtggtggacccagtctaggtgcgatgcttagtcacgcacgatgactctgtcggaaggcatctttactttcggcaaactttaataatactttaggaaaagtattgtacaagttaggtgcagaatcaataatgcacccagctttagtcttgtctactgaattattgtgtcggttgcattattggatgcctgcgtgcaccctaagcaatccccggctc

SEQ ID NO: 107 - DNA, 202 bp, Figwort mosaic virus
atcgagcagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaa

SEQ ID NO: 108 - DNA, 184 bp, Peanut chlorotic streak virus
caacgagatcatgagccaatcaaagaggagtgatgtagacctaaagcaataatggagccatgacgtaagggcttacgcccatacgaaataattaaaggctgatgtgacctgtcggtctctcagaacctttactttttatgtttggcgtgtatttttaaatttccacggcaatgacgatgtgacc

SEQ ID NO: 109 - DNA, 187 bp, Mirabilis Mosaic Virus
ccactaaaacattgctttgtcaaaagctaaaaaagatgatgcccgacagccacttgtgtgaagcatgagaagccggtccctccactaagaaaattagtgaagcatcttccagtggtccctccactcacagctcaatcagtgagcaacaggacgaaggaaatgacgtaagccatgacgtctaatccca

SEQ ID NO: 110 - DNA, 1068 bp, Zea mays
atggcgcccagcagctacgaggtggcggcttccatcctcctctgcgccgaggacagcagcagcatcctggacctcgaagcggaggccgaggaggaagcgctactggcgcggagcggggagcccggcggcggcgcggagttccccgtgccgtccgaggaatgcgtcgccggtttcctggagtctgaggcagcgcacatgccgcgggaggactacgccgagaggctgcgcagcggggggatggatctccgcgtccggacggacgccatcgactggatttggaaggttcacacgtgctacggtttcggccctctcactgcctgcttggccgtcaactacctggaccgcttcctctcgctctaccagcttccggaaggcaaggcttggatgacacagctgctgtccgtggcgtgcttgtccctggccgccaagatggaggagacctacgtcccttcgtccctggacctgcaggccggggacgcgcggtacgtgttcgaggcgaagacgatccagaggatggagctcctggtcctcagcacgctcaagtggaggatgcaagcggtcacccccttgtcgtacgtcgactacttcctccaccggctccgaggcggcgccgcgccgagcagacgcgccgtcctccgatccgcggagctcatcctgtgcatcgccagagggacgcactgcttggatttcaggccctcggagatcgccttggccgtcgccgccaccgtggccggcgaagagcgcgccgtggacatcgacagggccttcacccaccgtgtacataaggagagggtgtcgcgatgcctcgaagcgatccagcaggccaccgccaccatggccctgccgcagccgctgaaaagtgaaggcccgagcagcagcggccgcagggcctcgtcttcctcggccaccgtgccgcggagccccaccggggtgctggacgctggctgcctgagctacaggagagccgccgccgccgccgcctcgcacgcgagctccagctggcgcgacgaggacgacgacgactgccccccggctgtctgcagcaagaggaggaagattagcagatga

SEQ ID NO: 111 - protein, 355 aa, Zea mays
MAPSSYEVAASILLCAEDSSSILDLEAEAEEEALLARSGEPGGGAEFPVPSEECVAGFLESEAAHMPREDYAERLRSGGMDLRVRTDAIDWIWKVHTCYGFGPLTACLAVNYLDRFLSLYQLPEGKAWMTQLLSVACLSLAAKMEETYVPSSLDLQAGDARYVFEAKTIQRMELLVLSTLKWRMQAVTPLSYVDYFLHRLRGGAAPSRRAVLRSAELILCIARGTHCLDFRPSEIALAVAATVAGEERAVDIDRAFTHRVHKERVSRCLEAIQQATATMALPQPLKSEGPSSSGRRASSSSATVPRSPTGVLDAGCLSYRRAAAAAASHASSSWRDEDDDDCPPAVCSKRRKISR

SEQ ID NO: 112 - DNA, 26439 bp, Artificial Sequence
  RV035609
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatctgcggttaccgaattcgagctcggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtaagtttctgcttctacctttgatatatatataataattatcattaattagtagtaatataatatttcaaatatttttttcaaaataaaagaatgtagtatatagcaattgcttttctgtagtttataacttcgtatagcatacattatacgaagttatacttttctaatatatgaccaaaatttgttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccgggatctgagtcgaaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagatcgatgggccctggccgaagcttggtcacccggtccgggcctagaaggccagcttcaagtttgtaccctggagcttgccgagtgccatccttggacactcgataaagtatattttattttttttattttgccaaccaaactttttgtggtatgttcctacactatgtagatctacatgtaccattttggcacaattacatatttacaaaaatgttttctataaatattagatttagttcgtttatttgaatttcttcggaaaattcacatttaaactgcaagtcactcgaaacatggaaaaccgtgcatgcaaaataaatgatatgcatgttatctagcacaagttacgaccgatttcagaagcagaccagaatcttcaagcaccatgctcactaaacatgaccgtgaacttgttatctagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtactcgacaaagaagccgttgtcgatgtactgttcgtcgagatctctttgtcgagtgtcacactaggcaaagtctttacggagtgtttttcaggctttgacactcggcaaagcgctcgattccagtagtgacagtaatttgcatcaaaaatagctgagagatttaggccccgtttcaatctcacgggataaagtttagcttcctgctaaactttagctatatgaattgaagtgctaaagtttagtttcaattaccaccattagctctcctgtttagattacaaatggctaaaagtagctaaaaaatagctgctaaagtttatctcgcgagattgaaacagggccttaaaatgagtcaactaatagaccaactaattattagctattagtcgttagcttctttaatctaagctaaaaccaactaatagcttatttgttgaattacaattagctcaacggaattctctgtttttctaaaaaaaaactgcccctctcttacagcaaattgtccgctgcccgtcgtccagatacaatgaacgtacctagtaggaactcttttacacgctcggtcgctcgccgcggatcggagtccccggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaaggatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgagctagacccagctttcttgtacaaagtggccgttaacggatccagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcaagctgttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccatttcaaatatttttttcaaaataaaagaatgtagtatatagcaattgcttttctgtagtttataacttcgtatagcatacattatacgaagttatacttttctaatatatgaccaaaatttgttgatgtgcaggtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgatgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacataaagctttccactggttgccatatatgatttgggcatttcactttgatcttaatgggccttgtaaagcccaagactcatgattatctttagttgatgctcttaattaggtgtgggcaaataattcaaactgtatgtacccgaccaaaaccaaagcaaaaataatcgaaccaaaccgaaaatttaaaaataaccgaatgaaaactaaatcctataactgaaagaactgaaaccgaatcaaaatatttaatgtaaccaaaaatatccgaaatataattatattgtcaaaaatattaataatttctagattaaataattaaaaatacttaaaaatttatataaaatagtaaaaatactcgaaaataaccacaaatattcaaaaacaaccgaaatatcccaaaatattcaaagcaaaataaccgaatggataccaaattttaaaaccgaaaaaactggaacaaaaccaaaatcgaaccaaaatttcaaaaatcgaataaatactaaactttagaacaaaaaaaaacgataaccgaatgtatacgaaccaaagccgaattagataaccgaacgtccaggactactcttaatctttccgccacttatgatttgggctattactttgtttataatgagccttttcaagctcaagttcatgattgtccgtgagatgagaaactgacttgttggattcgaaaccctagctagtattggttaatacttaatacataaatgacctgcattgacatcatcatccaagaaaataaaaattgtatgcttgagatatttagttttcctagctaggttttctttattttagtaccgaatctttaggtgtgccacgttaatttagacccattttttcatacttaccaactgagtctagtttaatcatgactataatcgtataaaatgattcagtcgacgtcattgcgaacgtatataaaatcatccaaattgacgtcattccaaagaggtaagcatgcttatctaagagtccgagcatactaaacaagacgacattttatttgcactccaaatcaaattttgtattgcctaaagaaaaacaatcaaactcaagtttcttaaaattaatttcattcaaactaatcactttcaatatctcacatattattcatgccatttctatttgtctaaacatgatttaaaaaaaaaagtaaaatacaaagattactatgcaaaaactctataaaaaaaaattcaaatttcttatttatttgtgacatcaaattttcaaaataatttttttaattatcggttgatccggtcagtcgataaaaacataaactttcagcgaccgttaaaactttcctactaccgatttagagaaaatcttagcttgaaacgtaattgtaacctgccttcatgcaagtcgcaagatatgtcatcctaagttgtatatgttttctcaaaagatgtatttacttgagaaaatacgtttcaacgttgatggacaaccaattaagaatcaagcacctttcgtaatcaatttaggcttatcgtctaaggtatactgatttacgacagttgactagacttataaggaacaaaataatagaatagtttctaaacacttcacctaatcatagagactaagatggtaattcgtaaacgacaaagcctagtgacactgtccattgtaaaattccacatcatattagtattaaacatatacatgtagtttcctgaacacatgtagtatcaaacacacttcgtggcttcttcctcgaaacctgcggccgctcattaattaagtcatctagttgaaggatcgctatcaactttgtatagaaaagttgggccgaattcgagctcggtacggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaggctccggcgagggtcgcggttccctcctgacctgcggcgacgtggaggaaaaccccggtccgatggcgcccagcagctacgaggtggcggcttccatcctcctctgcgccgaggacagcagcagcatcctggacctcgaagcggaggccgaggaggaagcgctactggcgcggagcggggagcccggcggcggcgcggagttccccgtgccgtccgaggaatgcgtcgccggtttcctggagtctgaggcagcgcacatgccgcgggaggactacgccgagaggctgcgcagcggggggatggatctccgcgtccggacggacgccatcgactggatttggaaggttcacacgtgctacggtttcggccctctcactgcctgcttggccgtcaactacctggaccgcttcctctcgctctaccagcttccggaaggcaaggcttggatgacacagctgctgtccgtggcgtgcttgtccctggccgccaagatggaggagacctacgtcccttcgtccctggacctgcaggccggggacgcgcggtacgtgttcgaggcgaagacgatccagaggatggagctcctggtcctcagcacgctcaagtggaggatgcaagcggtcacccccttgtcgtacgtcgactacttcctccaccggctccgaggcggcgccgcgccgagcagacgcgccgtcctccgatccgcggagctcatcctgtgcatcgccagagggacgcactgcttggatttcaggccctcggagatcgccttggccgtcgccgccaccgtggccggcgaagagcgcgccgtggacatcgacagggccttcacccaccgtgtacataaggagagggtgtcgcgatgcctcgaagcgatccagcaggccaccgccaccatggccctgccgcagccgctgaaaagtgaaggcccgagcagcagcggccgcagggcctcgtcttcctcggccaccgtgccgcggagccccaccggggtgctggacgctggctgcctgagctacaggagagccgccgccgccgccgcctcgcacgcgagctccagctggcgcgacgaggacgacgacgactgccccccggctgtctgcagcaagaggaggaagattagcagatgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgggttaccgaattcgagctcggtaccctgggatccgatatcgatgggccctggccgaagcttggtcacccggtccgggcctagaaggccgatctcccgggcacccagctttcttgtacaaagtggccgttaacggatcggccagaatggcccggaccgggttaccgaattcgagctcggtaccctgggatccgatatcgatgggccctggccgaagcttggtcacccggtccgggcctagaaggccagcttcggccgccccgggcaactttattatacaaagttgatagatcctcatgtcttcatcgtaagcttaaacaggccagaatggcctctggattcagcggcctagaaggccgaagtacttggtcttcctagtcgagtagatcacattcaagcttggtcacccggtccgtcaatattctgattccgatgacttcgtaggttcctagctcaagccgctcgtgtccaagcgtcacttacgattagctaatgattacggcatctaggaccgactagtggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 113 - DNA, 26772 bp, Artificial Sequence
  RX000001
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatctgcggttaccgaattcgagctcggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtaagtttctgcttctacctttgatatatatataataattatcattaattagtagtaatataatatttcaaatatttttttcaaaataaaagaatgtagtatatagcaattgcttttctgtagtttataacttcgtatagcatacattatacgaagttatacttttctaatatatgaccaaaatttgttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccgggatctgagtcgaaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagatcgatgggccctggccgaagcttggtcacccggtccgggcctagaaggccagcttcaagtttgtaccctggagcttgccgagtgccatccttggacactcgataaagtatattttattttttttattttgccaaccaaactttttgtggtatgttcctacactatgtagatctacatgtaccattttggcacaattacatatttacaaaaatgttttctataaatattagatttagttcgtttatttgaatttcttcggaaaattcacatttaaactgcaagtcactcgaaacatggaaaaccgtgcatgcaaaataaatgatatgcatgttatctagcacaagttacgaccgatttcagaagcagaccagaatcttcaagcaccatgctcactaaacatgaccgtgaacttgttatctagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtactcgacaaagaagccgttgtcgatgtactgttcgtcgagatctctttgtcgagtgtcacactaggcaaagtctttacggagtgtttttcaggctttgacactcggcaaagcgctcgattccagtagtgacagtaatttgcatcaaaaatagctgagagatttaggccccgtttcaatctcacgggataaagtttagcttcctgctaaactttagctatatgaattgaagtgctaaagtttagtttcaattaccaccattagctctcctgtttagattacaaatggctaaaagtagctaaaaaatagctgctaaagtttatctcgcgagattgaaacagggccttaaaatgagtcaactaatagaccaactaattattagctattagtcgttagcttctttaatctaagctaaaaccaactaatagcttatttgttgaattacaattagctcaacggaattctctgtttttctaaaaaaaaactgcccctctcttacagcaaattgtccgctgcccgtcgtccagatacaatgaacgtacctagtaggaactcttttacacgctcggtcgctcgccgcggatcggagtccccggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaaggatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgagctagacccagctttcttgtacaaagtggccgttaacggatccagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcaagctgttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccatttcaaatatttttttcaaaataaaagaatgtagtatatagcaattgcttttctgtagtttataacttcgtatagcatacattatacgaagttatacttttctaatatatgaccaaaatttgttgatgtgcaggtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgatgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacataaagctttccactggttgccatatatgatttgggcatttcactttgatcttaatgggccttgtaaagcccaagactcatgattatctttagttgatgctcttaattaggtgtgggcaaataattcaaactgtatgtacccgaccaaaaccaaagcaaaaataatcgaaccaaaccgaaaatttaaaaataaccgaatgaaaactaaatcctataactgaaagaactgaaaccgaatcaaaatatttaatgtaaccaaaaatatccgaaatataattatattgtcaaaaatattaataatttctagattaaataattaaaaatacttaaaaatttatataaaatagtaaaaatactcgaaaataaccacaaatattcaaaaacaaccgaaatatcccaaaatattcaaagcaaaataaccgaatggataccaaattttaaaaccgaaaaaactggaacaaaaccaaaatcgaaccaaaatttcaaaaatcgaataaatactaaactttagaacaaaaaaaaacgataaccgaatgtatacgaaccaaagccgaattagataaccgaacgtccaggactactcttaatctttccgccacttatgatttgggctattactttgtttataatgagccttttcaagctcaagttcatgattgtccgtgagatgagaaactgacttgttggattcgaaaccctagctagtattggttaatacttaatacataaatgacctgcattgacatcatcatccaagaaaataaaaattgtatgcttgagatatttagttttcctagctaggttttctttattttagtaccgaatctttaggtgtgccacgttaatttagacccattttttcatacttaccaactgagtctagtttaatcatgactataatcgtataaaatgattcagtcgacgtcattgcgaacgtatataaaatcatccaaattgacgtcattccaaagaggtaagcatgcttatctaagagtccgagcatactaaacaagacgacattttatttgcactccaaatcaaattttgtattgcctaaagaaaaacaatcaaactcaagtttcttaaaattaatttcattcaaactaatcactttcaatatctcacatattattcatgccatttctatttgtctaaacatgatttaaaaaaaaaagtaaaatacaaagattactatgcaaaaactctataaaaaaaaattcaaatttcttatttatttgtgacatcaaattttcaaaataatttttttaattatcggttgatccggtcagtcgataaaaacataaactttcagcgaccgttaaaactttcctactaccgatttagagaaaatcttagcttgaaacgtaattgtaacctgccttcatgcaagtcgcaagatatgtcatcctaagttgtatatgttttctcaaaagatgtatttacttgagaaaatacgtttcaacgttgatggacaaccaattaagaatcaagcacctttcgtaatcaatttaggcttatcgtctaaggtatactgatttacgacagttgactagacttataaggaacaaaataatagaatagtttctaaacacttcacctaatcatagagactaagatggtaattcgtaaacgacaaagcctagtgacactgtccattgtaaaattccacatcatattagtattaaacatatacatgtagtttcctgaacacatgtagtatcaaacacacttcgtggcttcttcctcgaaacctgcggccgctcattaattaagtcatctagttgaaggatcgctatcaactttgtatagaaaagttgggccgaattcgagctcggtacggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatgatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggataaggctccggcgagggtcgcggttccctcctgacctgcggcgacgtggaggaaaaccccggtccgatggcgcccagcagctacgaggtggcggcttccatcctcctctgcgccgaggacagcagcagcatcctggacctcgaagcggaggccgaggaggaagcgctactggcgcggagcggggagcccggcggcggcgcggagttccccgtgccgtccgaggaatgcgtcgccggtttcctggagtctgaggcagcgcacatgccgcgggaggactacgccgagaggctgcgcagcggggggatggatctccgcgtccggacggacgccatcgactggatttggaaggttcacacgtgctacggtttcggccctctcactgcctgcttggccgtcaactacctggaccgcttcctctcgctctaccagcttccggaaggcaaggcttggatgacacagctgctgtccgtggcgtgcttgtccctggccgccaagatggaggagacctacgtcccttcgtccctggacctgcaggccggggacgcgcggtacgtgttcgaggcgaagacgatccagaggatggagctcctggtcctcagcacgctcaagtggaggatgcaagcggtcacccccttgtcgtacgtcgactacttcctccaccggctccgaggcggcgccgcgccgagcagacgcgccgtcctccgatccgcggagctcatcctgtgcatcgccagagggacgcactgcttggatttcaggccctcggagatcgccttggccgtcgccgccaccgtggccggcgaagagcgcgccgtggacatcgacagggccttcacccaccgtgtacataaggagagggtgtcgcgatgcctcgaagcgatccagcaggccaccgccaccatggccctgccgcagccgctgaaaagtgaaggcccgagcagcagcggccgcagggcctcgtcttcctcggccaccgtgccgcggagccccaccggggtgctggacgctggctgcctgagctacaggagagccgccgccgccgccgcctcgcacgcgagctccagctggcgcgacgaggacgacgacgactgccccccggctgtctgcagcaagaggaggaagattagcagatgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgggttaccgaattcgagctcggtaccctgggatccgatatcgatgggccctggccgaagcttggtcacccggtccgggcctagaaggccgatctcccgggcacccagctttcttgtacaaagtggccgttaacggatcggccagaatggcccggaccgggttaccgaattcgagctcggtaccctgggatccgatatcgatgggccctggccgaagcttggtcacccggtccgggcctagaaggccagcttcggccgccccgggcaactttattatacaaagttgatagatcctcatgtcttcatcgtaagcttaaacaggccagaatggcctctggattcagcggcctagaaggccgaagtacttggtcttcctagtcgagtagatcacattcaagcttggtcacccggtccgtcaatattctgattccgatgacttcgtaggttcctagctcaagccgctcgtgtccaagcgtcacttacgattagctaatgattacggcatctaggaccgactagtggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 114 - DNA, 27060 bp, Artificial Sequence
  RX000002
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatctgcggttaccgaattcgagctcggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtaagtttctgcttctacctttgatatatatataataattatcattaattagtagtaatataatatttcaaatatttttttcaaaataaaagaatgtagtatatagcaattgcttttctgtagtttataacttcgtatagcatacattatacgaagttatacttttctaatatatgaccaaaatttgttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccgggatctgagtcgaaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagatcgatgggccctggccgaagcttggtcacccggtccgggcctagaaggccagcttcaagtttgtaccctggagcttgccgagtgccatccttggacactcgataaagtatattttattttttttattttgccaaccaaactttttgtggtatgttcctacactatgtagatctacatgtaccattttggcacaattacatatttacaaaaatgttttctataaatattagatttagttcgtttatttgaatttcttcggaaaattcacatttaaactgcaagtcactcgaaacatggaaaaccgtgcatgcaaaataaatgatatgcatgttatctagcacaagttacgaccgatttcagaagcagaccagaatcttcaagcaccatgctcactaaacatgaccgtgaacttgttatctagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtactcgacaaagaagccgttgtcgatgtactgttcgtcgagatctctttgtcgagtgtcacactaggcaaagtctttacggagtgtttttcaggctttgacactcggcaaagcgctcgattccagtagtgacagtaatttgcatcaaaaatagctgagagatttaggccccgtttcaatctcacgggataaagtttagcttcctgctaaactttagctatatgaattgaagtgctaaagtttagtttcaattaccaccattagctctcctgtttagattacaaatggctaaaagtagctaaaaaatagctgctaaagtttatctcgcgagattgaaacagggccttaaaatgagtcaactaatagaccaactaattattagctattagtcgttagcttctttaatctaagctaaaaccaactaatagcttatttgttgaattacaattagctcaacggaattctctgtttttctaaaaaaaaactgcccctctcttacagcaaattgtccgctgcccgtcgtccagatacaatgaacgtacctagtaggaactcttttacacgctcggtcgctcgccgcggatcggagtccccggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaaggatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgagctagacccagctttcttgtacaaagtggccgttaacggatccagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcaagctgttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccatttcaaatatttttttcaaaataaaagaatgtagtatatagcaattgcttttctgtagtttataacttcgtatagcatacattatacgaagttatacttttctaatatatgaccaaaatttgttgatgtgcaggtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgatgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacataaagctttccactggttgccatatatgatttgggcatttcactttgatcttaatgggccttgtaaagcccaagactcatgattatctttagttgatgctcttaattaggtgtgggcaaataattcaaactgtatgtacccgaccaaaaccaaagcaaaaataatcgaaccaaaccgaaaatttaaaaataaccgaatgaaaactaaatcctataactgaaagaactgaaaccgaatcaaaatatttaatgtaaccaaaaatatccgaaatataattatattgtcaaaaatattaataatttctagattaaataattaaaaatacttaaaaatttatataaaatagtaaaaatactcgaaaataaccacaaatattcaaaaacaaccgaaatatcccaaaatattcaaagcaaaataaccgaatggataccaaattttaaaaccgaaaaaactggaacaaaaccaaaatcgaaccaaaatttcaaaaatcgaataaatactaaactttagaacaaaaaaaaacgataaccgaatgtatacgaaccaaagccgaattagataaccgaacgtccaggactactcttaatctttccgccacttatgatttgggctattactttgtttataatgagccttttcaagctcaagttcatgattgtccgtgagatgagaaactgacttgttggattcgaaaccctagctagtattggttaatacttaatacataaatgacctgcattgacatcatcatccaagaaaataaaaattgtatgcttgagatatttagttttcctagctaggttttctttattttagtaccgaatctttaggtgtgccacgttaatttagacccattttttcatacttaccaactgagtctagtttaatcatgactataatcgtataaaatgattcagtcgacgtcattgcgaacgtatataaaatcatccaaattgacgtcattccaaagaggtaagcatgcttatctaagagtccgagcatactaaacaagacgacattttatttgcactccaaatcaaattttgtattgcctaaagaaaaacaatcaaactcaagtttcttaaaattaatttcattcaaactaatcactttcaatatctcacatattattcatgccatttctatttgtctaaacatgatttaaaaaaaaaagtaaaatacaaagattactatgcaaaaactctataaaaaaaaattcaaatttcttatttatttgtgacatcaaattttcaaaataatttttttaattatcggttgatccggtcagtcgataaaaacataaactttcagcgaccgttaaaactttcctactaccgatttagagaaaatcttagcttgaaacgtaattgtaacctgccttcatgcaagtcgcaagatatgtcatcctaagttgtatatgttttctcaaaagatgtatttacttgagaaaatacgtttcaacgttgatggacaaccaattaagaatcaagcacctttcgtaatcaatttaggcttatcgtctaaggtatactgatttacgacagttgactagacttataaggaacaaaataatagaatagtttctaaacacttcacctaatcatagagactaagatggtaattcgtaaacgacaaagcctagtgacactgtccattgtaaaattccacatcatattagtattaaacatatacatgtagtttcctgaacacatgtagtatcaaacacacttcgtggcttcttcctcgaaacctgcggccgctcattaattaagtcatctagttgaaggatcgctatcaactttgtatagaaaagttgggccgaattcgagctcggtacggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatggcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcctcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggataaggctccggcgagggtcgcggttccctcctgacctgcggcgacgtggaggaaaaccccggtccgatggcgcccagcagctacgaggtggcggcttccatcctcctctgcgccgaggacagcagcagcatcctggacctcgaagcggaggccgaggaggaagcgctactggcgcggagcggggagcccggcggcggcgcggagttccccgtgccgtccgaggaatgcgtcgccggtttcctggagtctgaggcagcgcacatgccgcgggaggactacgccgagaggctgcgcagcggggggatggatctccgcgtccggacggacgccatcgactggatttggaaggttcacacgtgctacggtttcggccctctcactgcctgcttggccgtcaactacctggaccgcttcctctcgctctaccagcttccggaaggcaaggcttggatgacacagctgctgtccgtggcgtgcttgtccctggccgccaagatggaggagacctacgtcccttcgtccctggacctgcaggccggggacgcgcggtacgtgttcgaggcgaagacgatccagaggatggagctcctggtcctcagcacgctcaagtggaggatgcaagcggtcacccccttgtcgtacgtcgactacttcctccaccggctccgaggcggcgccgcgccgagcagacgcgccgtcctccgatccgcggagctcatcctgtgcatcgccagagggacgcactgcttggatttcaggccctcggagatcgccttggccgtcgccgccaccgtggccggcgaagagcgcgccgtggacatcgacagggccttcacccaccgtgtacataaggagagggtgtcgcgatgcctcgaagcgatccagcaggccaccgccaccatggccctgccgcagccgctgaaaagtgaaggcccgagcagcagcggccgcagggcctcgtcttcctcggccaccgtgccgcggagccccaccggggtgctggacgctggctgcctgagctacaggagagccgccgccgccgccgcctcgcacgcgagctccagctggcgcgacgaggacgacgacgactgccccccggctgtctgcagcaagaggaggaagattagcagatgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgggttaccgaattcgagctcggtaccctgggatccgatatcgatgggccctggccgaagcttggtcacccggtccgggcctagaaggccgatctcccgggcacccagctttcttgtacaaagtggccgttaacggatcggccagaatggcccggaccgggttaccgaattcgagctcggtaccctgggatccgatatcgatgggccctggccgaagcttggtcacccggtccgggcctagaaggccagcttcggccgccccgggcaactttattatacaaagttgatagatcctcatgtcttcatcgtaagcttaaacaggccagaatggcctctggattcagcggcctagaaggccgaagtacttggtcttcctagtcgagtagatcacattcaagcttggtcacccggtccgtcaatattctgattccgatgacttcgtaggttcctagctcaagccgctcgtgtccaagcgtcacttacgattagctaatgattacggcatctaggaccgactagtggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 115 - DNA, 26547 bp, Artificial Sequence
  RX000003
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatctgcggttaccgaattcgagctcggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtaagtttctgcttctacctttgatatatatataataattatcattaattagtagtaatataatatttcaaatatttttttcaaaataaaagaatgtagtatatagcaattgcttttctgtagtttataacttcgtatagcatacattatacgaagttatacttttctaatatatgaccaaaatttgttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccgggatctgagtcgaaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagatcgatgggccctggccgaagcttggtcacccggtccgggcctagaaggccagcttcaagtttgtaccctggagcttgccgagtgccatccttggacactcgataaagtatattttattttttttattttgccaaccaaactttttgtggtatgttcctacactatgtagatctacatgtaccattttggcacaattacatatttacaaaaatgttttctataaatattagatttagttcgtttatttgaatttcttcggaaaattcacatttaaactgcaagtcactcgaaacatggaaaaccgtgcatgcaaaataaatgatatgcatgttatctagcacaagttacgaccgatttcagaagcagaccagaatcttcaagcaccatgctcactaaacatgaccgtgaacttgttatctagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtactcgacaaagaagccgttgtcgatgtactgttcgtcgagatctctttgtcgagtgtcacactaggcaaagtctttacggagtgtttttcaggctttgacactcggcaaagcgctcgattccagtagtgacagtaatttgcatcaaaaatagctgagagatttaggccccgtttcaatctcacgggataaagtttagcttcctgctaaactttagctatatgaattgaagtgctaaagtttagtttcaattaccaccattagctctcctgtttagattacaaatggctaaaagtagctaaaaaatagctgctaaagtttatctcgcgagattgaaacagggccttaaaatgagtcaactaatagaccaactaattattagctattagtcgttagcttctttaatctaagctaaaaccaactaatagcttatttgttgaattacaattagctcaacggaattctctgtttttctaaaaaaaaactgcccctctcttacagcaaattgtccgctgcccgtcgtccagatacaatgaacgtacctagtaggaactcttttacacgctcggtcgctcgccgcggatcggagtccccggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaaggatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgagctagacccagctttcttgtacaaagtggccgttaacggatccagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcaagctgttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccatttcaaatatttttttcaaaataaaagaatgtagtatatagcaattgcttttctgtagtttataacttcgtatagcatacattatacgaagttatacttttctaatatatgaccaaaatttgttgatgtgcaggtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgatgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacataaagctttccactggttgccatatatgatttgggcatttcactttgatcttaatgggccttgtaaagcccaagactcatgattatctttagttgatgctcttaattaggtgtgggcaaataattcaaactgtatgtacccgaccaaaaccaaagcaaaaataatcgaaccaaaccgaaaatttaaaaataaccgaatgaaaactaaatcctataactgaaagaactgaaaccgaatcaaaatatttaatgtaaccaaaaatatccgaaatataattatattgtcaaaaatattaataatttctagattaaataattaaaaatacttaaaaatttatataaaatagtaaaaatactcgaaaataaccacaaatattcaaaaacaaccgaaatatcccaaaatattcaaagcaaaataaccgaatggataccaaattttaaaaccgaaaaaactggaacaaaaccaaaatcgaaccaaaatttcaaaaatcgaataaatactaaactttagaacaaaaaaaaacgataaccgaatgtatacgaaccaaagccgaattagataaccgaacgtccaggactactcttaatctttccgccacttatgatttgggctattactttgtttataatgagccttttcaagctcaagttcatgattgtccgtgagatgagaaactgacttgttggattcgaaaccctagctagtattggttaatacttaatacataaatgacctgcattgacatcatcatccaagaaaataaaaattgtatgcttgagatatttagttttcctagctaggttttctttattttagtaccgaatctttaggtgtgccacgttaatttagacccattttttcatacttaccaactgagtctagtttaatcatgactataatcgtataaaatgattcagtcgacgtcattgcgaacgtatataaaatcatccaaattgacgtcattccaaagaggtaagcatgcttatctaagagtccgagcatactaaacaagacgacattttatttgcactccaaatcaaattttgtattgcctaaagaaaaacaatcaaactcaagtttcttaaaattaatttcattcaaactaatcactttcaatatctcacatattattcatgccatttctatttgtctaaacatgatttaaaaaaaaaagtaaaatacaaagattactatgcaaaaactctataaaaaaaaattcaaatttcttatttatttgtgacatcaaattttcaaaataatttttttaattatcggttgatccggtcagtcgataaaaacataaactttcagcgaccgttaaaactttcctactaccgatttagagaaaatcttagcttgaaacgtaattgtaacctgccttcatgcaagtcgcaagatatgtcatcctaagttgtatatgttttctcaaaagatgtatttacttgagaaaatacgtttcaacgttgatggacaaccaattaagaatcaagcacctttcgtaatcaatttaggcttatcgtctaaggtatactgatttacgacagttgactagacttataaggaacaaaataatagaatagtttctaaacacttcacctaatcatagagactaagatggtaattcgtaaacgacaaagcctagtgacactgtccattgtaaaattccacatcatattagtattaaacatatacatgtagtttcctgaacacatgtagtatcaaacacacttcgtggcttcttcctcgaaacctgcggccgctcattaattaagtcatctagttgaaggatcgctatcaactttgtatagaaaagttgggccgaattcgagctcggtacggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggataaggctccggcgagggtcgcggttccctcctgacctgcggcgacgtggaggaaaaccccggtccgatggcgcccagcagctacgaggtggcggcttccatcctcctctgcgccgaggacagcagcagcatcctggacctcgaagcggaggccgaggaggaagcgctactggcgcggagcggggagcccggcggcggcgcggagttccccgtgccgtccgaggaatgcgtcgccggtttcctggagtctgaggcagcgcacatgccgcgggaggactacgccgagaggctgcgcagcggggggatggatctccgcgtccggacggacgccatcgactggatttggaaggttcacacgtgctacggtttcggccctctcactgcctgcttggccgtcaactacctggaccgcttcctctcgctctaccagcttccggaaggcaaggcttggatgacacagctgctgtccgtggcgtgcttgtccctggccgccaagatggaggagacctacgtcccttcgtccctggacctgcaggccggggacgcgcggtacgtgttcgaggcgaagacgatccagaggatggagctcctggtcctcagcacgctcaagtggaggatgcaagcggtcacccccttgtcgtacgtcgactacttcctccaccggctccgaggcggcgccgcgccgagcagacgcgccgtcctccgatccgcggagctcatcctgtgcatcgccagagggacgcactgcttggatttcaggccctcggagatcgccttggccgtcgccgccaccgtggccggcgaagagcgcgccgtggacatcgacagggccttcacccaccgtgtacataaggagagggtgtcgcgatgcctcgaagcgatccagcaggccaccgccaccatggccctgccgcagccgctgaaaagtgaaggcccgagcagcagcggccgcagggcctcgtcttcctcggccaccgtgccgcggagccccaccggggtgctggacgctggctgcctgagctacaggagagccgccgccgccgccgcctcgcacgcgagctccagctggcgcgacgaggacgacgacgactgccccccggctgtctgcagcaagaggaggaagattagcagatgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgggttaccgaattcgagctcggtaccctgggatccgatatcgatgggccctggccgaagcttggtcacccggtccgggcctagaaggccgatctcccgggcacccagctttcttgtacaaagtggccgttaacggatcggccagaatggcccggaccgggttaccgaattcgagctcggtaccctgggatccgatatcgatgggccctggccgaagcttggtcacccggtccgggcctagaaggccagcttcggccgccccgggcaactttattatacaaagttgatagatcctcatgtcttcatcgtaagcttaaacaggccagaatggcctctggattcagcggcctagaaggccgaagtacttggtcttcctagtcgagtagatcacattcaagcttggtcacccggtccgtcaatattctgattccgatgacttcgtaggttcctagctcaagccgctcgtgtccaagcgtcacttacgattagctaatgattacggcatctaggaccgactagtggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 116 - DNA, 26532 bp, Artificial Sequence
  RX000004
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatctgcggttaccgaattcgagctcggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtaagtttctgcttctacctttgatatatatataataattatcattaattagtagtaatataatatttcaaatatttttttcaaaataaaagaatgtagtatatagcaattgcttttctgtagtttataacttcgtatagcatacattatacgaagttatacttttctaatatatgaccaaaatttgttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccgggatctgagtcgaaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagatcgatgggccctggccgaagcttggtcacccggtccgggcctagaaggccagcttcaagtttgtaccctggagcttgccgagtgccatccttggacactcgataaagtatattttattttttttattttgccaaccaaactttttgtggtatgttcctacactatgtagatctacatgtaccattttggcacaattacatatttacaaaaatgttttctataaatattagatttagttcgtttatttgaatttcttcggaaaattcacatttaaactgcaagtcactcgaaacatggaaaaccgtgcatgcaaaataaatgatatgcatgttatctagcacaagttacgaccgatttcagaagcagaccagaatcttcaagcaccatgctcactaaacatgaccgtgaacttgttatctagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtactcgacaaagaagccgttgtcgatgtactgttcgtcgagatctctttgtcgagtgtcacactaggcaaagtctttacggagtgtttttcaggctttgacactcggcaaagcgctcgattccagtagtgacagtaatttgcatcaaaaatagctgagagatttaggccccgtttcaatctcacgggataaagtttagcttcctgctaaactttagctatatgaattgaagtgctaaagtttagtttcaattaccaccattagctctcctgtttagattacaaatggctaaaagtagctaaaaaatagctgctaaagtttatctcgcgagattgaaacagggccttaaaatgagtcaactaatagaccaactaattattagctattagtcgttagcttctttaatctaagctaaaaccaactaatagcttatttgttgaattacaattagctcaacggaattctctgtttttctaaaaaaaaactgcccctctcttacagcaaattgtccgctgcccgtcgtccagatacaatgaacgtacctagtaggaactcttttacacgctcggtcgctcgccgcggatcggagtccccggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaaggatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgagctagacccagctttcttgtacaaagtggccgttaacggatccagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcaagctgttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccatttcaaatatttttttcaaaataaaagaatgtagtatatagcaattgcttttctgtagtttataacttcgtatagcatacattatacgaagttatacttttctaatatatgaccaaaatttgttgatgtgcaggtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgatgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacataaagctttccactggttgccatatatgatttgggcatttcactttgatcttaatgggccttgtaaagcccaagactcatgattatctttagttgatgctcttaattaggtgtgggcaaataattcaaactgtatgtacccgaccaaaaccaaagcaaaaataatcgaaccaaaccgaaaatttaaaaataaccgaatgaaaactaaatcctataactgaaagaactgaaaccgaatcaaaatatttaatgtaaccaaaaatatccgaaatataattatattgtcaaaaatattaataatttctagattaaataattaaaaatacttaaaaatttatataaaatagtaaaaatactcgaaaataaccacaaatattcaaaaacaaccgaaatatcccaaaatattcaaagcaaaataaccgaatggataccaaattttaaaaccgaaaaaactggaacaaaaccaaaatcgaaccaaaatttcaaaaatcgaataaatactaaactttagaacaaaaaaaaacgataaccgaatgtatacgaaccaaagccgaattagataaccgaacgtccaggactactcttaatctttccgccacttatgatttgggctattactttgtttataatgagccttttcaagctcaagttcatgattgtccgtgagatgagaaactgacttgttggattcgaaaccctagctagtattggttaatacttaatacataaatgacctgcattgacatcatcatccaagaaaataaaaattgtatgcttgagatatttagttttcctagctaggttttctttattttagtaccgaatctttaggtgtgccacgttaatttagacccattttttcatacttaccaactgagtctagtttaatcatgactataatcgtataaaatgattcagtcgacgtcattgcgaacgtatataaaatcatccaaattgacgtcattccaaagaggtaagcatgcttatctaagagtccgagcatactaaacaagacgacattttatttgcactccaaatcaaattttgtattgcctaaagaaaaacaatcaaactcaagtttcttaaaattaatttcattcaaactaatcactttcaatatctcacatattattcatgccatttctatttgtctaaacatgatttaaaaaaaaaagtaaaatacaaagattactatgcaaaaactctataaaaaaaaattcaaatttcttatttatttgtgacatcaaattttcaaaataatttttttaattatcggttgatccggtcagtcgataaaaacataaactttcagcgaccgttaaaactttcctactaccgatttagagaaaatcttagcttgaaacgtaattgtaacctgccttcatgcaagtcgcaagatatgtcatcctaagttgtatatgttttctcaaaagatgtatttacttgagaaaatacgtttcaacgttgatggacaaccaattaagaatcaagcacctttcgtaatcaatttaggcttatcgtctaaggtatactgatttacgacagttgactagacttataaggaacaaaataatagaatagtttctaaacacttcacctaatcatagagactaagatggtaattcgtaaacgacaaagcctagtgacactgtccattgtaaaattccacatcatattagtattaaacatatacatgtagtttcctgaacacatgtagtatcaaacacacttcgtggcttcttcctcgaaacctgcggccgctcattaattaagtcatctagttgaaggatcgctatcaactttgtatagaaaagttgggccgaattcgagctcggtacggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatgatcgggctgtccatgattaagaactggctgcggagccaaccggcgcccggtggaggcggcagcggtggcggaggctccggaggcggtggcgacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggataaggctccggcgagggtcgcggttccctcctgacctgcggcgacgtggaggaaaaccccggtccgatggcgcccagcagctacgaggtggcggcttccatcctcctctgcgccgaggacagcagcagcatcctggacctcgaagcggaggccgaggaggaagcgctactggcgcggagcggggagcccggcggcggcgcggagttccccgtgccgtccgaggaatgcgtcgccggtttcctggagtctgaggcagcgcacatgccgcgggaggactacgccgagaggctgcgcagcggggggatggatctccgcgtccggacggacgccatcgactggatttggaaggttcacacgtgctacggtttcggccctctcactgcctgcttggccgtcaactacctggaccgcttcctctcgctctaccagcttccggaaggcaaggcttggatgacacagctgctgtccgtggcgtgcttgtccctggccgccaagatggaggagacctacgtcccttcgtccctggacctgcaggccggggacgcgcggtacgtgttcgaggcgaagacgatccagaggatggagctcctggtcctcagcacgctcaagtggaggatgcaagcggtcacccccttgtcgtacgtcgactacttcctccaccggctccgaggcggcgccgcgccgagcagacgcgccgtcctccgatccgcggagctcatcctgtgcatcgccagagggacgcactgcttggatttcaggccctcggagatcgccttggccgtcgccgccaccgtggccggcgaagagcgcgccgtggacatcgacagggccttcacccaccgtgtacataaggagagggtgtcgcgatgcctcgaagcgatccagcaggccaccgccaccatggccctgccgcagccgctgaaaagtgaaggcccgagcagcagcggccgcagggcctcgtcttcctcggccaccgtgccgcggagccccaccggggtgctggacgctggctgcctgagctacaggagagccgccgccgccgccgcctcgcacgcgagctccagctggcgcgacgaggacgacgacgactgccccccggctgtctgcagcaagaggaggaagattagcagatgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgggttaccgaattcgagctcggtaccctgggatccgatatcgatgggccctggccgaagcttggtcacccggtccgggcctagaaggccgatctcccgggcacccagctttcttgtacaaagtggccgttaacggatcggccagaatggcccggaccgggttaccgaattcgagctcggtaccctgggatccgatatcgatgggccctggccgaagcttggtcacccggtccgggcctagaaggccagcttcggccgccccgggcaactttattatacaaagttgatagatcctcatgtcttcatcgtaagcttaaacaggccagaatggcctctggattcagcggcctagaaggccgaagtacttggtcttcctagtcgagtagatcacattcaagcttggtcacccggtccgtcaatattctgattccgatgacttcgtaggttcctagctcaagccgctcgtgtccaagcgtcacttacgattagctaatgattacggcatctaggaccgactagtggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 117 - DNA, 26514 bp, Artificial Sequence
  RX000005
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatctgcggttaccgaattcgagctcggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtaagtttctgcttctacctttgatatatatataataattatcattaattagtagtaatataatatttcaaatatttttttcaaaataaaagaatgtagtatatagcaattgcttttctgtagtttataacttcgtatagcatacattatacgaagttatacttttctaatatatgaccaaaatttgttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccgggatctgagtcgaaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagatcgatgggccctggccgaagcttggtcacccggtccgggcctagaaggccagcttcaagtttgtaccctggagcttgccgagtgccatccttggacactcgataaagtatattttattttttttattttgccaaccaaactttttgtggtatgttcctacactatgtagatctacatgtaccattttggcacaattacatatttacaaaaatgttttctataaatattagatttagttcgtttatttgaatttcttcggaaaattcacatttaaactgcaagtcactcgaaacatggaaaaccgtgcatgcaaaataaatgatatgcatgttatctagcacaagttacgaccgatttcagaagcagaccagaatcttcaagcaccatgctcactaaacatgaccgtgaacttgttatctagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtactcgacaaagaagccgttgtcgatgtactgttcgtcgagatctctttgtcgagtgtcacactaggcaaagtctttacggagtgtttttcaggctttgacactcggcaaagcgctcgattccagtagtgacagtaatttgcatcaaaaatagctgagagatttaggccccgtttcaatctcacgggataaagtttagcttcctgctaaactttagctatatgaattgaagtgctaaagtttagtttcaattaccaccattagctctcctgtttagattacaaatggctaaaagtagctaaaaaatagctgctaaagtttatctcgcgagattgaaacagggccttaaaatgagtcaactaatagaccaactaattattagctattagtcgttagcttctttaatctaagctaaaaccaactaatagcttatttgttgaattacaattagctcaacggaattctctgtttttctaaaaaaaaactgcccctctcttacagcaaattgtccgctgcccgtcgtccagatacaatgaacgtacctagtaggaactcttttacacgctcggtcgctcgccgcggatcggagtccccggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaaggatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgagctagacccagctttcttgtacaaagtggccgttaacggatccagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcaagctgttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccatttcaaatatttttttcaaaataaaagaatgtagtatatagcaattgcttttctgtagtttataacttcgtatagcatacattatacgaagttatacttttctaatatatgaccaaaatttgttgatgtgcaggtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgatgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacataaagctttccactggttgccatatatgatttgggcatttcactttgatcttaatgggccttgtaaagcccaagactcatgattatctttagttgatgctcttaattaggtgtgggcaaataattcaaactgtatgtacccgaccaaaaccaaagcaaaaataatcgaaccaaaccgaaaatttaaaaataaccgaatgaaaactaaatcctataactgaaagaactgaaaccgaatcaaaatatttaatgtaaccaaaaatatccgaaatataattatattgtcaaaaatattaataatttctagattaaataattaaaaatacttaaaaatttatataaaatagtaaaaatactcgaaaataaccacaaatattcaaaaacaaccgaaatatcccaaaatattcaaagcaaaataaccgaatggataccaaattttaaaaccgaaaaaactggaacaaaaccaaaatcgaaccaaaatttcaaaaatcgaataaatactaaactttagaacaaaaaaaaacgataaccgaatgtatacgaaccaaagccgaattagataaccgaacgtccaggactactcttaatctttccgccacttatgatttgggctattactttgtttataatgagccttttcaagctcaagttcatgattgtccgtgagatgagaaactgacttgttggattcgaaaccctagctagtattggttaatacttaatacataaatgacctgcattgacatcatcatccaagaaaataaaaattgtatgcttgagatatttagttttcctagctaggttttctttattttagtaccgaatctttaggtgtgccacgttaatttagacccattttttcatacttaccaactgagtctagtttaatcatgactataatcgtataaaatgattcagtcgacgtcattgcgaacgtatataaaatcatccaaattgacgtcattccaaagaggtaagcatgcttatctaagagtccgagcatactaaacaagacgacattttatttgcactccaaatcaaattttgtattgcctaaagaaaaacaatcaaactcaagtttcttaaaattaatttcattcaaactaatcactttcaatatctcacatattattcatgccatttctatttgtctaaacatgatttaaaaaaaaaagtaaaatacaaagattactatgcaaaaactctataaaaaaaaattcaaatttcttatttatttgtgacatcaaattttcaaaataatttttttaattatcggttgatccggtcagtcgataaaaacataaactttcagcgaccgttaaaactttcctactaccgatttagagaaaatcttagcttgaaacgtaattgtaacctgccttcatgcaagtcgcaagatatgtcatcctaagttgtatatgttttctcaaaagatgtatttacttgagaaaatacgtttcaacgttgatggacaaccaattaagaatcaagcacctttcgtaatcaatttaggcttatcgtctaaggtatactgatttacgacagttgactagacttataaggaacaaaataatagaatagtttctaaacacttcacctaatcatagagactaagatggtaattcgtaaacgacaaagcctagtgacactgtccattgtaaaattccacatcatattagtattaaacatatacatgtagtttcctgaacacatgtagtatcaaacacacttcgtggcttcttcctcgaaacctgcggccgctcattaattaagtcatctagttgaaggatcgctatcaactttgtatagaaaagttgggccgaattcgagctcggtacggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatggcggagccgaagctggaggacttcctcggcggtggaggcggcagcggtggcggaggctccggaggcggtggcgacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggataaggctccggcgagggtcgcggttccctcctgacctgcggcgacgtggaggaaaaccccggtccgatggcgcccagcagctacgaggtggcggcttccatcctcctctgcgccgaggacagcagcagcatcctggacctcgaagcggaggccgaggaggaagcgctactggcgcggagcggggagcccggcggcggcgcggagttccccgtgccgtccgaggaatgcgtcgccggtttcctggagtctgaggcagcgcacatgccgcgggaggactacgccgagaggctgcgcagcggggggatggatctccgcgtccggacggacgccatcgactggatttggaaggttcacacgtgctacggtttcggccctctcactgcctgcttggccgtcaactacctggaccgcttcctctcgctctaccagcttccggaaggcaaggcttggatgacacagctgctgtccgtggcgtgcttgtccctggccgccaagatggaggagacctacgtcccttcgtccctggacctgcaggccggggacgcgcggtacgtgttcgaggcgaagacgatccagaggatggagctcctggtcctcagcacgctcaagtggaggatgcaagcggtcacccccttgtcgtacgtcgactacttcctccaccggctccgaggcggcgccgcgccgagcagacgcgccgtcctccgatccgcggagctcatcctgtgcatcgccagagggacgcactgcttggatttcaggccctcggagatcgccttggccgtcgccgccaccgtggccggcgaagagcgcgccgtggacatcgacagggccttcacccaccgtgtacataaggagagggtgtcgcgatgcctcgaagcgatccagcaggccaccgccaccatggccctgccgcagccgctgaaaagtgaaggcccgagcagcagcggccgcagggcctcgtcttcctcggccaccgtgccgcggagccccaccggggtgctggacgctggctgcctgagctacaggagagccgccgccgccgccgcctcgcacgcgagctccagctggcgcgacgaggacgacgacgactgccccccggctgtctgcagcaagaggaggaagattagcagatgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgggttaccgaattcgagctcggtaccctgggatccgatatcgatgggccctggccgaagcttggtcacccggtccgggcctagaaggccgatctcccgggcacccagctttcttgtacaaagtggccgttaacggatcggccagaatggcccggaccgggttaccgaattcgagctcggtaccctgggatccgatatcgatgggccctggccgaagcttggtcacccggtccgggcctagaaggccagcttcggccgccccgggcaactttattatacaaagttgatagatcctcatgtcttcatcgtaagcttaaacaggccagaatggcctctggattcagcggcctagaaggccgaagtacttggtcttcctagtcgagtagatcacattcaagcttggtcacccggtccgtcaatattctgattccgatgacttcgtaggttcctagctcaagccgctcgtgtccaagcgtcacttacgattagctaatgattacggcatctaggaccgactagtggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 118 - DNA, 26604 bp, Artificial Sequence
  RX000006
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatctgcggttaccgaattcgagctcggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtaagtttctgcttctacctttgatatatatataataattatcattaattagtagtaatataatatttcaaatatttttttcaaaataaaagaatgtagtatatagcaattgcttttctgtagtttataacttcgtatagcatacattatacgaagttatacttttctaatatatgaccaaaatttgttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccgggatctgagtcgaaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagatcgatgggccctggccgaagcttggtcacccggtccgggcctagaaggccagcttcaagtttgtaccctggagcttgccgagtgccatccttggacactcgataaagtatattttattttttttattttgccaaccaaactttttgtggtatgttcctacactatgtagatctacatgtaccattttggcacaattacatatttacaaaaatgttttctataaatattagatttagttcgtttatttgaatttcttcggaaaattcacatttaaactgcaagtcactcgaaacatggaaaaccgtgcatgcaaaataaatgatatgcatgttatctagcacaagttacgaccgatttcagaagcagaccagaatcttcaagcaccatgctcactaaacatgaccgtgaacttgttatctagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtactcgacaaagaagccgttgtcgatgtactgttcgtcgagatctctttgtcgagtgtcacactaggcaaagtctttacggagtgtttttcaggctttgacactcggcaaagcgctcgattccagtagtgacagtaatttgcatcaaaaatagctgagagatttaggccccgtttcaatctcacgggataaagtttagcttcctgctaaactttagctatatgaattgaagtgctaaagtttagtttcaattaccaccattagctctcctgtttagattacaaatggctaaaagtagctaaaaaatagctgctaaagtttatctcgcgagattgaaacagggccttaaaatgagtcaactaatagaccaactaattattagctattagtcgttagcttctttaatctaagctaaaaccaactaatagcttatttgttgaattacaattagctcaacggaattctctgtttttctaaaaaaaaactgcccctctcttacagcaaattgtccgctgcccgtcgtccagatacaatgaacgtacctagtaggaactcttttacacgctcggtcgctcgccgcggatcggagtccccggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaaggatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgagctagacccagctttcttgtacaaagtggccgttaacggatccagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcaagctgttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccatttcaaatatttttttcaaaataaaagaatgtagtatatagcaattgcttttctgtagtttataacttcgtatagcatacattatacgaagttatacttttctaatatatgaccaaaatttgttgatgtgcaggtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgatgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacataaagctttccactggttgccatatatgatttgggcatttcactttgatcttaatgggccttgtaaagcccaagactcatgattatctttagttgatgctcttaattaggtgtgggcaaataattcaaactgtatgtacccgaccaaaaccaaagcaaaaataatcgaaccaaaccgaaaatttaaaaataaccgaatgaaaactaaatcctataactgaaagaactgaaaccgaatcaaaatatttaatgtaaccaaaaatatccgaaatataattatattgtcaaaaatattaataatttctagattaaataattaaaaatacttaaaaatttatataaaatagtaaaaatactcgaaaataaccacaaatattcaaaaacaaccgaaatatcccaaaatattcaaagcaaaataaccgaatggataccaaattttaaaaccgaaaaaactggaacaaaaccaaaatcgaaccaaaatttcaaaaatcgaataaatactaaactttagaacaaaaaaaaacgataaccgaatgtatacgaaccaaagccgaattagataaccgaacgtccaggactactcttaatctttccgccacttatgatttgggctattactttgtttataatgagccttttcaagctcaagttcatgattgtccgtgagatgagaaactgacttgttggattcgaaaccctagctagtattggttaatacttaatacataaatgacctgcattgacatcatcatccaagaaaataaaaattgtatgcttgagatatttagttttcctagctaggttttctttattttagtaccgaatctttaggtgtgccacgttaatttagacccattttttcatacttaccaactgagtctagtttaatcatgactataatcgtataaaatgattcagtcgacgtcattgcgaacgtatataaaatcatccaaattgacgtcattccaaagaggtaagcatgcttatctaagagtccgagcatactaaacaagacgacattttatttgcactccaaatcaaattttgtattgcctaaagaaaaacaatcaaactcaagtttcttaaaattaatttcattcaaactaatcactttcaatatctcacatattattcatgccatttctatttgtctaaacatgatttaaaaaaaaaagtaaaatacaaagattactatgcaaaaactctataaaaaaaaattcaaatttcttatttatttgtgacatcaaattttcaaaataatttttttaattatcggttgatccggtcagtcgataaaaacataaactttcagcgaccgttaaaactttcctactaccgatttagagaaaatcttagcttgaaacgtaattgtaacctgccttcatgcaagtcgcaagatatgtcatcctaagttgtatatgttttctcaaaagatgtatttacttgagaaaatacgtttcaacgttgatggacaaccaattaagaatcaagcacctttcgtaatcaatttaggcttatcgtctaaggtatactgatttacgacagttgactagacttataaggaacaaaataatagaatagtttctaaacacttcacctaatcatagagactaagatggtaattcgtaaacgacaaagcctagtgacactgtccattgtaaaattccacatcatattagtattaaacatatacatgtagtttcctgaacacatgtagtatcaaacacacttcgtggcttcttcctcgaaacctgcggccgctcattaattaagtcatctagttgaaggatcgctatcaactttgtatagaaaagttgggccgaattcgagctcggtacggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatggcggagccgaagctggaggacttcctcggcggtggaggcggcagcggtggcggaggctccggaggcggtggcatcgggctgtccatgattaagaactggctgcggagccaaccggcgcccggtggaggcggcagcggtggcggaggctccggaggcggtggcgacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggataaggctccggcgagggtcgcggttccctcctgacctgcggcgacgtggaggaaaaccccggtccgatggcgcccagcagctacgaggtggcggcttccatcctcctctgcgccgaggacagcagcagcatcctggacctcgaagcggaggccgaggaggaagcgctactggcgcggagcggggagcccggcggcggcgcggagttccccgtgccgtccgaggaatgcgtcgccggtttcctggagtctgaggcagcgcacatgccgcgggaggactacgccgagaggctgcgcagcggggggatggatctccgcgtccggacggacgccatcgactggatttggaaggttcacacgtgctacggtttcggccctctcactgcctgcttggccgtcaactacctggaccgcttcctctcgctctaccagcttccggaaggcaaggcttggatgacacagctgctgtccgtggcgtgcttgtccctggccgccaagatggaggagacctacgtcccttcgtccctggacctgcaggccggggacgcgcggtacgtgttcgaggcgaagacgatccagaggatggagctcctggtcctcagcacgctcaagtggaggatgcaagcggtcacccccttgtcgtacgtcgactacttcctccaccggctccgaggcggcgccgcgccgagcagacgcgccgtcctccgatccgcggagctcatcctgtgcatcgccagagggacgcactgcttggatttcaggccctcggagatcgccttggccgtcgccgccaccgtggccggcgaagagcgcgccgtggacatcgacagggccttcacccaccgtgtacataaggagagggtgtcgcgatgcctcgaagcgatccagcaggccaccgccaccatggccctgccgcagccgctgaaaagtgaaggcccgagcagcagcggccgcagggcctcgtcttcctcggccaccgtgccgcggagccccaccggggtgctggacgctggctgcctgagctacaggagagccgccgccgccgccgcctcgcacgcgagctccagctggcgcgacgaggacgacgacgactgccccccggctgtctgcagcaagaggaggaagattagcagatgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgggttaccgaattcgagctcggtaccctgggatccgatatcgatgggccctggccgaagcttggtcacccggtccgggcctagaaggccgatctcccgggcacccagctttcttgtacaaagtggccgttaacggatcggccagaatggcccggaccgggttaccgaattcgagctcggtaccctgggatccgatatcgatgggccctggccgaagcttggtcacccggtccgggcctagaaggccagcttcggccgccccgggcaactttattatacaaagttgatagatcctcatgtcttcatcgtaagcttaaacaggccagaatggcctctggattcagcggcctagaaggccgaagtacttggtcttcctagtcgagtagatcacattcaagcttggtcacccggtccgtcaatattctgattccgatgacttcgtaggttcctagctcaagccgctcgtgtccaagcgtcacttacgattagctaatgattacggcatctaggaccgactagtggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 119 - DNA, 1218 bp, Zea mays; identical to SEQ ID NO: 2

SEQ ID NO: 120 - DNA, 1380 bp, Artificial Sequence; identical to SEQ ID NO: 10
  ZM-ODP2 bait 2

SEQ ID NO: 121 - DNA, 1494 bp, Artificial Sequence
  PvEC1:(1X ZM-AS2-20)
cctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaacgtaagcgcttacgcattccggccgcctagcgctgctatatata

SEQ ID NO: 122 - DNA, 1524 bp, Artificial Sequence
  PvEC1:(2X ZM-AS2-20)
cctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaaaacaacgtaagcgcttacgcaccgaacaacgtaagcgcttacgcacttccggccgcctagcgctgctatatata

SEQ ID NO: 123 - DNA, 1548 bp, Artificial Sequence
  PvEC1:(3X ZM-AS2-20)
cctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaaaacaacgtaagcgcttacgcaccgaacaacgtaagcgcttacgcaccgaacaacgtaagcgcttacgcacttccggccgcctagcgctgctatatata

SEQ ID NO: 124 - DNA, 1524 bp, Artificial Sequence
  PvEC1:(2X ZM-AS2-60)
cctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaacaacgtaagcgcttacgcaccgaacaacgtaagcgcttacgcacaatccaagtcggtgtacccccgaatcgtcgatcatattaattccggccgcctagcgctgctatatata

SEQ ID NO: 125 - DNA, 1524 bp, Artificial Sequence
  PvEC1:(2X ZM-AS2-100)
cctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttaacaacgtaagcgcttacgcaccgaacaacgtaagcgcttacgcacggccttccatgaaacgcacgcactcatgtacgccgcccacaatccaagtcggtgtacccccgaatcgtcgatcatattaattccggccgcctagcgctgctatatata

SEQ ID NO: 126 - DNA, 1521 bp, Artificial Sequence
  PvEC1:(2X ZM-AS2-20)
cctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaaaacaacgtaagcgcttacgcaccgaacaacgtaagcgcttacgcacttccggccgcctagcgctgctataa

SEQ ID NO: 127 - DNA, 1521 bp, Artificial Sequence
  PvEC1:(2X ZM-AS2-60)
cctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaacaacgtaagcgcttacgcaccgaacaacgtaagcgcttacgcacaatccaagtcggtgtacccccgaatcgtcgatcatattaattccggccgcctagcgctgctataa

SEQ ID NO: 128 - DNA, 1510 bp, Zea mays
gaattcactaccagcagcatgatcagagtgaggatagttgctacttcaatggcctaggtttgataactactgtcgatccatctgtcgacaattgtttgtttcctctcacaattcacgtttctgccgccacttctttgcacctaacattgcccgtgtcgctgttattagttttgtggttttgcattgtctgtatatagtctgatgaggctatagattgagccttcaaaagtgtttcgttgggcctcttgttgaatgtactccaaagtctcggtgcaccatcagacgtattcctagaatggcacaatctggctatcagaactggtaggtttagtccaaatgtaatgatgtgttctaaagtagtcgggctgagtcaaacagcagcttcttctcttgttcaaaattttgaacctggtaatgttgtcatttcatgatagatcatagatacattcttggtttcactatatcttagaaagtccagccaacagaagtactcaagtacaggtgaacctttcagtttagctggagacctgggcagcagtgtacaaagtctaatccacagctgtgaccctgtgagctgggggttgggcctgcctcggaggggatcgtgtcttttctgtttgtgcaattatcagtgcctaaagaacatgtgttataacagttatacacggtcaattattcaatccatcttttaacgtgtgtttggttgtacgtataagaagggatcaaagagggcggccacattttctataacatttggatgagagtcacacgagaacgagatgaacaccgaagtaattttttatgacagcatgatccaaaaaaatcgagagaacggtgttatccccgtctcatcctattttgatctcaaaccaaacacataattagtcaatgagcactgacttgatgtagaagaacttggtacatataccaggaaatgactctgacttgctgagatgccttgtagtccctcggtcccgtaaattatacagtagtatttaaacttcctcgcacaaaggaaaactatttgtttttgcatgccttgtaaattagctatcaagtttttttttaaaaaaaacgacctttgaaaaccagtaaggaggactcgttcggtattcagttttaaagttcaaggttaaaaatcgaactgacgtgcaaaacaccctgggggttaaaatcaaaacacacaaatttggaaaatgagcaggcatgacttatgttgtgtccgttgaagtgccgtggctccttggcacggtggaactttacattagtgcggtagtgtcactgtggcagtaaagcccacttattttccattagagagagggagattaaaaacgtggctttacacattctgaaactaattgtgagtttgtgactcttggcttgcctgcagtgtccgcctgcaccttctataagtacagtcgcgagcctcagctatacaaaccaactagcgcatagtatctcctgagctccattcatcatcccaagtcttcactggtcttagatcccatgg

SEQ ID NO: 129 - DNA, 1142 bp, Triticum aestivum
gaattctgtagctgcccaatgacttggaggctcgatttgagccttcaagatttgtccgtgtgtctcatgtagcatgtgttaactcaaaaatcttgcgcactgtcaaaactagtactagtatctctgaagttgtgcaaattcgtactacgttgtagaggactccatgcatactccacttggctcgggggggatatagctcagttggtagagctccgctcttgcaattgggtcgttgcgattacgggttggctgtctaattgtccaggcggggttaggatctgaggaagcttagtttggatgatggaacattcgctgttctgattgttgagataccgcaaatccacttatccaacaatttcagtccattttcctactttttctgcagcccgttgcaaggaaggaaagagcaagaactagggctaagtgctgagttacggttgttgactcggaattgtaagccgaagaagcattcctgtgacctggccgtatgaatggtttctttctcaataccagagctaaataattaggcatcaaaattcaaagaaggtgatacttttcacgtactcctttggtttggaggaatttcataggaattgtagatgataggattcttataggatttttttcctatagagccatttggttcataggaatggattcctatttctacataggattggttcctatccttcatatttaataggaaaataaaaataaacctagactcaatggaaaaattcctttggtgtcaaccaaatgacatctcgtttcctattcctactcataggatttgagatacatatcatctcatttcctataaaattcatattcctacgataattttatcctatgaaccaaaagaggcctcaactactcgtaccatgaaagaaaggggattttggggggagatgagaaacgaggggatcacgccccgattaattttctgtggatagagtaacgtaggaaggagaggaaggggcaacgcattcgcgtttaattaagataattttgattcgtttggacttccacgttctcgtaaagccttttcgcttacctgacgtttcggttacttgctatgataagtagtagtacgtcagcctcctcactcggtagcaccagctagagtcgacctcagaccatgg

SEQ ID NO: 130 - DNA, 1772 bp, Artificial Sequence
  SynPRO-04
gaattctgcaattgggtcgttgcgattacgggttggctgtctaattgtccaggcggggttaggatctgaggaagcttagtttggatgatggaacattcgctgttctgattgttgagataccgcaaatccacttatccaacaatttcagtccattttcctactttttctgcagcccgttgcaaggaaggaaagagcaagaactagggctaagtgctgagttacggttgttgactcggaattgtaagccgaagaagcattcctgtgacctggccgtatgaatggtttctttctcaataccagagctaaataattaggcatcaaaattcaaagaaggtgatacttttcacgtactcctttggtttggaggaatttcataggaattgtagatgataggattcttataggatttttttcctatagagccatttggttcataggaatggattcctatttctacataggattggttcctatccttcatatttaataggaaaataaaaataaacctagactcaatggaaaaattcctttggtgtcaaccaaatgacatctcgtttcctattcctactcataggatttgagatacatatcatctcatttcctataaaattcatattcctacgataattttatcctatgaaccaaaagaggcctcaactactcgtaccatgaaagaaaggggattttggggggagatgagaaacgaggggatcacgccccgattaattttctgtggatagagtaacgtaggaaggagaggaaggggcaacgcattcgcgtttaattaagataattttgattcgtttggacttccaaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggtaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagccatgg

SEQ ID NO: 131 - DNA, 1784 bp, Artificial Sequence
  SynPRO-05
gaattcagtgtacaaagtctaatccacagctgtgaccctgtgagctgggggttgggcctgcctcggaggggatcgtgtcttttctgtttgtgcaattatcagtgcctaaagaacatgtgttataacagttatacacggtcaattattcaatccatcttttaacgtgtgtttggttgtacgtataagaagggatcaaagagggcggccacattttctataacatttggatgagagtcacacgagaacgagatgaacaccgaagtaattttttatgacagcatgatccaaaaaaatcgagagaacggtgttatccccgtctcatcctattttgatctcaaaccaaacacataattagtcaatgagcactgacttgatgtagaagaacttggtacatataccaggaaatgactctgacttgctgagatgccttgtagtccctcggtcccgtaaattatacagtagtatttaaacttcctcgcacaaaggaaaactatttgtttttgcatgccttgtaaattagctatcaagtttttttttaaaaaaaacgacctttgaaaaccagtaaggaggactcgttcggtattcagttttaaagttcaaggttaaaaatcgaactgacgtgcaaaacaccctgggggttaaaatcaaaacacacaaatttggaaaatgagcaggcatgacttatgttgtgtccgttgaagtgccgtggctccaaggcacggtggaactttacattagtgcggtagtgtcactgtggcagtaaagcccacttattttccattagagagagggagattaaaaacgtggctttacacattctgaaactaaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggtaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagccatgg

SEQ ID NO: 132 - DNA, 2593 bp, Artificial Sequence
  SynPRO-06
gaattctgcaattgggtcgttgcgattacgggttggctgtctaattgtccaggcggggttaggatctgaggaagcttagtttggatgatggaacattcgctgttctgattgttgagataccgcaaatccacttatccaacaatttcagtccattttcctactttttctgcagcccgttgcaaggaaggaaagagcaagaactagggctaagtgctgagttacggttgttgactcggaattgtaagccgaagaagcattcctgtgacctggccgtatgaatggtttctttctcaataccagagctaaataattaggcatcaaaattcaaagaaggtgatacttttcacgtactcctttggtttggaggaatttcataggaattctagatgataggattcttataggatttttttcctatagagccatttggttcataggaatggattcctatttctacataggattggttcctatccttcatatttaataggaaaataaaaataaacctagactcaatggaaaaattcctttggtgtcaaccaaatgacatctcgtttcctattcctactcataggatttgagatacatatcatctcatttcctataaaattcatattcctacgataattttatcctatgaaccaaaagaggcctcaactactcgtaccatgaaagaaaggggattttggggggagatgagaaacgaggggatcacgccccgattaattttctgtggatagagtaacgtaggaaggagaggaaggggcaacgcattcgcgtttaattaagataattttgattcgtttggacttccaagtgtacaaagtctaatccacagctgtgaccctgtgagctgggggttgggcctgcctcggaggggatcgtgtcttttctgtttgtgcaattatcagtgcctaaagaacatgtgttataacagttatacacggtcaattattcaatccatcttttaacgtgtgtttggttgtacgtataagaagggatcaaagagggcggccacattttctataacatttggatgagagtcacacgagaacgagatgaacaccgaagtaattttttatgacagcatgatccaaaaaaatcgagagaacggtgttatccccgtctcatcctattttgatctcaaaccaaacacataattagtcaatgagcactgacttgatgtagaagaacttggtacatataccaggaaatgactctgacttgctgagatgccttgtagtccctcggtcccgtaaattatacagtagtatttaaacttcctcgcacaaaggaaaactatttgtttttgcatgccttgtaaattagctatcaagtttttttttaaaaaaaacgacctttgaaaaccagtaaggaggactcgttcggtattcagttttaaagttcaaggttaaaaatcgaactgacgtgcaaaacaccctgggggttaaaatcaaaacacacaaatttggaaaatgagcaggcatgacttatgttgtgtccgttgaagtgccgtggctccatggcacggtggaactttacattagtgcggtagtgtcactgtggcagtaaagcccacttattttccattagagagagggagattaaaaacgtggctttacacattctgaaactaaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggtaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagccatgg

SEQ ID NO: 133 - DNA, 2593 bp, Artificial Sequence
  SynPRO-07
gaattcagtgtacaaagtctaatccacagctgtgaccctgtgagctgggggttgggcctgcctcggaggggatcgtgtcttttctgtttgtgcaattatcagtgcctaaagaacatgtgttataacagttatacacggtcaattattcaatccatcttttaacgtgtgtttggttgtacgtataagaagggatcaaagagggcggccacattttctataacatttggatgagagtcacacgagaacgagatgaacaccgaagtaattttttatgacagcatgatccaaaaaaatcgagagaacggtgttatccccgtctcatcctattttgatctcaaaccaaacacataattagtcaatgagcactgacttgatgtagaagaacttggtacatataccaggaaatgactctgacttgctgagatgccttgtagtccctcggtcccgtaaattatacagtagtatttaaacttcctcgcacaaaggaaaactatttgtttttgcatgccttgtaaattagctatcaagtttttttttaaaaaaaacgacctttgaaaaccagtaaggaggactcgttcggtattcagttttaaagttcaaggttaaaaatcgaactgacgtgcaaaacaccctgggggttaaaatcaaaacacacaaatttggaaaatgagcaggcatgacttatgttgtgtccgttgaagtgccgtggctccatggcacggtggaactttacattagtgcggtagtgtcactgtggcagtaaagcccacttattttccattagagagagggagattaaaaacgtggctttacacattctgaaactatgcaattgggtcgttgcgattacgggttggctgtctaattgtccaggcggggttaggatctgaggaagcttagtttggatgatggaacattcgctgttctgattgttgagataccgcaaatccacttatccaacaatttcagtccattttcctactttttctgcagcccgttgcaaggaaggaaagagcaagaactagggctaagtgctgagttacggttgttgactcggaattgtaagccgaagaagcattcctgtgacctggccgtatgaatggtttctttctcaataccagagctaaataattaggcatcaaaattcaaagaaggtgatacttttcacgtactcctttggtttggaggaatttcataggaattctagatgataggattcttataggatttttttcctatagagccatttggttcataggaatggattcctatttctacataggattggttcctatccttcatatttaataggaaaataaaaataaacctagactcaatggaaaaattcctttggtgtcaaccaaatgacatctcgtttcctattcctactcataggatttgagatacatatcatctcatttcctataaaattcatattcctacgataattttatcctatgaaccaaaagaggcctcaactactcgtaccatgaaagaaaggggattttggggggagatgagaaacgaggggatcacgccccgattaattttctgtggatagagtaacgtaggaaggagaggaaggggcaacgcattcgcgtttaattaagataattttgattcgtttggacttccaaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggtaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagccatgg

SEQ ID NO: 134 - DNA, 2589 bp, Artificial Sequence
  SynPRO-08
gaattcagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggtaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtctgcaattgggtcgttgcgattacgggttggctgtctaattgtccaggcggggttaggatctgaggaagcttagtttggatgatggaacattcgctgttctgattgttgagataccgcaaatccacttatccaacaatttcagtccattttcctactttttctgcagcccgttgcaaggaaggaaagagcaagaactagggctaagtgctgagttacggttgttgactcggaattgtaagccgaagaagcattcctgtgacctggccgtatgaatggtttctttctcaataccagagctaaataattaggcatcaaaattcaaagaaggtgatacttttcacgtactcctttggtttggaggaatttcataggaattgtagatgataggattcttataggatttttttcctatagagccatttggttcataggaatggattcctatttctacataggattggttcctatccttcatatttaataggaaaataaaaataaacctagactcaatggaaaaattcctttggtgtcaaccaaatgacatctcgtttcctattcctactcataggatttgagatacatatcatctcatttcctataaaattcatattcctacgataattttatcctatgaaccaaaagaggcctcaactactcgtaccatgaaagaaaggggattttggggggagatgagaaacgaggggatcacgccccgattaattttctgtggatagagtaacgtaggaaggagaggaaggggcaacgcattcgcgtttaattaagataattttgattcgtttggacttccaagtgtacaaagtctaatccacagctgtgaccctgtgagctgggggttgggcctgcctcggaggggatcgtgtcttttctgtttgtgcaattatcagtgcctaaagaacatgtgttataacagttatacacggtcaattattcaatccatcttttaacgtgtgtttggttgtacgtataagaagggatcaaagagggcggccacattttctataacatttggatgagagtcacacgagaacgagatgaacaccgaagtaattttttatgacagcatgatccaaaaaaatcgagagaacggtgttatccccgtctcatcctattttgatctcaaaccaaacacataattagtcaatgagcactgacttgatgtagaagaacttggtacatataccaggaaatgactctgacttgctgagatgccttgtagtccctcggtcccgtaaattatacagtagtatttaaacttcctcgcacaaaggaaaactatttgtttttgcatgccttgtaaattagctatcaagtttttttttaaaaaaaacgacctttgaaaaccagtaaggaggactcgttcggtattcagttttaaagttcaaggttaaaaatcgaactgacgtgcaaaacaccctgggggttaaaatcaaaacacacaaatttggaaaatgagcaggcatgacttatgttgtgtccgttgaagtgccgtggctccttggcacggtggaactttacattagtgcggtagtgtcactgtggcagtaaagcccacttattttccattagagagagggagattaaaaacgtggctttacacattctgaaactaattgtgagtttgtgactcttggcttgcctgcagtgtccgcctgcaccttctataagtacagtcgcgagcctcagctatacaaaccaactagcgcatagtatctcctgagctccattcatcatcccaagtcttcactggtcttagatcccatgg

SEQ ID NO: 135 - DNA, 2589 bp, Artificial Sequence
  SynPRO-09
gaattctgcaattgggtcgttgcgattacgggttggctgtctaattgtccaggcggggttaggatctgaggaagcttagtttggatgatggaacattcgctgttctgattgttgagataccgcaaatccacttatccaacaatttcagtccattttcctactttttctgcagcccgttgcaaggaaggaaagagcaagaactagggctaagtgctgagttacggttgttgactcggaattgtaagccgaagaagcattcctgtgacctggccgtatgaatggtttctttctcaataccagagctaaataattaggcatcaaaattcaaagaaggtgatacttttcacgtactcctttggtttggaggaatttcataggaattgtagatgataggattcttataggatttttttcctatagagccatttggttcataggaatggattcctatttctacataggattggttcctatccttcatatttaataggaaaataaaaataaacctagactcaatggaaaaattcctttggtgtcaaccaaatgacatctcgtttcctattcctactcataggatttgagatacatatcatctcatttcctataaaattcatattcctacgataattttatcctatgaaccaaaagaggcctcaactactcgtaccatgaaagaaaggggattttggggggagatgagaaacgaggggatcacgccccgattaattttctgtggatagagtaacgtaggaaggagaggaaggggcaacgcattcgcgtttaattaagataattttgattcgtttggacttccaagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggtaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcagtgtacaaagtctaatccacagctgtgaccctgtgagctgggggttgggcctgcctcggaggggatcgtgtcttttctgtttgtgcaattatcagtgcctaaagaacatgtgttataacagttatacacggtcaattattcaatccatcttttaacgtgtgtttggttgtacgtataagaagggatcaaagagggcggccacattttctataacatttggatgagagtcacacgagaacgagatgaacaccgaagtaattttttatgacagcatgatccaaaaaaatcgagagaacggtgttatccccgtctcatcctattttgatctcaaaccaaacacataattagtcaatgagcactgacttgatgtagaagaacttggtacatataccaggaaatgactctgacttgctgagatgccttgtagtccctcggtcccgtaaattatacagtagtatttaaacttcctcgcacaaaggaaaactatttgtttttgcatgccttgtaaattagctatcaagtttttttttaaaaaaaacgacctttgaaaaccagtaaggaggactcgttcggtattcagttttaaagttcaaggttaaaaatcgaactgacgtgcaaaacaccctgggggttaaaatcaaaacacacaaatttggaaaatgagcaggcatgacttatgttgtgtccgttgaagtgccgtggctccttggcacggtggaactttacattagtgcggtagtgtcactgtggcagtaaagcccacttattttccattagagagagggagattaaaaacgtggctttacacattctgaaactaattgtgagtttgtgactcttggcttgcctgcagtgtccgcctgcaccttctataagtacagtcgcgagcctcagctatacaaaccaactagcgcatagtatctcctgagctccattcatcatcccaagtcttcactggtcttagatcccatgg

SEQ ID NO: 136 - DNA, 8082 bp, Artificial Sequence
  ZM-NAC7
cgctttgctttgtcgcgacgcgagcctgcgcgttgcgttcgtggcgtcggggagggggggggatggcaagcgccggtttgctgtattggtcacgtgatgcggctgcgcaacggccggggccagggcggtgccgccgcggcgacgggatcgcgcgtggttggtgtgacggacgggtgggggcgcaccgagcgcatgccgcctccatgaggattgaggaggccctcccgtccggatgcatcacacatgccactggcttggctggctgggacgtgatcccctgcaccggctacgtgttcttccttctcaccgagaagatgctgacaatgaaaacggcggcctcgtcacggctccgacgcgatccgtgggcgggcgggcgcgtccctcgccggagctggcgccgcgtgtcgccttctctggaacgccacgtgcctgcgtgcgcgcgcgcgcgcgagacgtcctagtccccagtgatttcgcttggaaattttttttatccgaatcttgagggtctggaggagcttcatggctaccgagtgcccgtcagcccgtggtatttttaggtgtgaacggagcccggttctcgtcggatcgccagctttaataagcacgaggtagtaggtgcgaagaggagaacggccttaactaactgctctcctcacgctgccaggaatgagcttgacgacggtgctagctggcacgaccttattaattttttattactatattactagaaaacgattgatcacggcgaaaattaagcactcgcctcatgacccgatcctccgaagccccttcgcatcacggcgctttgcggtgcttgtctttgacttcttcttttttttaaaaaaaaactcgcaatgggtagtacacacgatagccgcagtctttaaaagttgattactcttctcaatctgacctgacgtttggctcaagtcgaactcgagccgggaaaaaataaatatattagttaacaactaaaccctcctgtaaattaagcctaagtacctaggatacgtccctcctgcctctaactacttttttattactatctttattatcgatagaatctagggtgtgtttgtttagcgggttgacgcgggttggaacagattcaacacataacaactcgtgtttggtttaaaaggctcgcgggttagattggttccgggtcgaaatacgtcttgaaaatatgggttctaaggattcctaaaaacaagcgaaccatttcgacccacttcctctctaccctactgtcacccatgtcttatccactcgagaccagcacagggcgtgccgccactgtcgagggaccccgccgacctaccctccgacgttaatcccctgcctgccactagtcgtcggtcccccactggcctacccgccagcatgctggcctccgccagcgccgtcagactccctgaccggcttgttgcgcctcccaccgtcagactcctcggctggcatgccctccgatgtcgtggtgttctccgataggcacaacttgcgagccttgctagtgctgtcgtcgaacaggtaaaggtcagtgctcgtcatcgcctagacaagcctgctagtcatgtcaaatgttaaaaattcactgaaatgtatcttagtgttgttgggatgttcctttaactataactgaaatgtaacagtgagacctcatcactaaaaaattatgacttggttaataatggctttaatttatgtatatattgtgcttattgatttctcaaatattaaaatagtgtcgtttcatttattttgaatgttgtcatcttattgaattgaattgaagatatatcattttgggtaatatgaccagtaaggttactatattaagtttatccctcatcatgaaataaataagagatggtgtagctactatgagttctatgtctatctagtgtccatgccggacatgtttcgttgcatgcttaatagtagcgccgagagcgttccctcctcttctcgcaagcgtgcctgccaactttgaaaaaaaaaatatcttagatatacctttgctctttgctttgagcgcttgtattttgtccttctgtttcttctttaccgagttaagtgcttaactagcatttgtggcaatcaccatcgatcatctgatctatggctgcatctttcttcaatcttggatgtggacttgacctagcccacgcacaacgacacctgcagagtaactgttagcccactaattatctactaccaaacgcaaggttttcaaaatctcccctgtatatacatatatggctttcaatcccgcaaatagatacgttcattcataggagtacgcacgtgtgccgtgcacgagggtctcggtttataccgtcttcttttttttttgaagaagaaaaaaaataaacttgtcctaagcaggacgtacggtagcacctactgccaataagatatatattgctgctggtaaaatattttataatgtttatgatcttatcattgaaaatttcgtgtgaagtttttaaatttaaaattcaaattttataaacggtcttggatgtagaaactattaaaataaaacttttagatctcaaaaagttatgcaactttatagttggtcacattttcaaatgaactcatttagtgccttaaataatcaaattactctcgatttgttatagtacatgggaaatggaaacgtaatataaatataattggtgtaatagtgtagtgctatagaagggtatgcgcgagagagaggttgcgagttcgaatctcaccatttacaaaacatataagtttgattcaaaataatagtgaaaaatgatagggcaacgggtaagggtagggttggagagttgttcctagaatttaaaaaatgttttgctgttttttttttaatttttttgattcttaatttgccgagtgtttttctttgccgagtgctttttgacactcggcaaagtctttgccgagtgtccgaaaaaaacactcggcaaagaaccctttgccgatgaaatctttgtcgagtgttaagcctttgtcgagtgtaaaatagtctttgccgagtgtcttagacactcggcaaagaacgtgattccggtagtgaatagatacgttcattcataggagtacgcacgtgtgccgtgcaggagggtctcggtttacaccatgttctttttttagaagaaaaaaattaaacttgtcctaagcaggacgtacggtagcacctactgccaataagatatatattgctgctggtaaaatattttataatgtttatggctttataatgtttaaacttgtcctaatagctgacacatgacagactctaacctttcagtttccttgaaaagcagtaggccagcagccacaccccaggcgacagatggcgcgatcgtccacatggtggaggtggatagcagcaatccaggcttttccagtttggttccaaggcggcctccgtgtttttaattttacacacacatatatacatcctcctctcgttttcttcggccacttcttttttcttcttcttcttctttttgttgcacacatatatgtattccagggaaatttcccttggtgtgtgccatatacatgcatgtggaggagacggggatggagagctgtgagctagtcccctttgtactacagaaagaaagtgcgtgctgcccttatttctggaatgaaaaggcagaatgggaagagggggaaaaaaggggatagatagatgtggaggttgagggagacccacaccaccatataaacccccctcttccaaactagtcacacatggcacaagcacacagctcatcagttcttcttcgtcgtcttggctagctgcctagctagctagctagttcctcactcctctccgagaaccccctttttcatctctctctctctctctcggtctcgcccagctcctttcgatgttatcgtctctgctggcctcgcaactcgtcgagagagactcgtgaaaaagaatccagatatagctagagagaccgagagggcagctagcatgtcgatgagcttcttgagcatggtggaggcggagctgccgccggggttccggttccacccgagggacgacgagctcatctgcgactacctcgcgcccaagctcggcgccaagcccggcttctccggctgccgcccgcccatggtcgacgtcgacctcaacaaggtcgagccatgggatctccccggtgagtacgtacgtccacgcaagtagctagataaatcttttttttaatttgctagcgctcctttctttttctacgaccttcttctcagctaataaaagctagctagctgtgcgtcttccttgattaattcctccatgatacttgcaccaagttgatgcatatatgcgcacggagaggagaaagatgcagagaaatcacacacgtcaaatttccctagcttgctcgacacaacacgatccttaaatctgtccctgtttattatattctagtccacgatcaaaactcacagctttttccgtttttttaaataaaacacagcctcttaatttctgctgttttttttaaaaaaatcatgattttccagaataaagctatttgggatcgatcctctgttgcttcagcgtcaagagaaacaccacacgagtccccggccaaatgtgctgttcatacactaaactgctgcacacacatcacaccactctcctacatacttttatttttcgtcagcaagctagctaggatattaatatcgacgttttgctacctaaacctttagaaataattcatgatcgatctcgttttcatgcctatatatgatcatttccttgtcttcctcttcactcggtatatgttttctatacctcttctttttgttaccatgaacttgacttgttgatgacgcctccccaacaaatgaatagttatgaccagctgtattttaagtcggaggtcaaactaaaattaagcagtaggtatacacacaccattaattaattgaaaaacacatcgatttaatttgttttccgttcgtcggctgtaattatccaatttgtacacgatggtttctttgtttgtttctgaaaccttctcgcgcgcgcggtggtataatatcaacgtcacgatcagagtacgcgtgtacacgtactgcgctctcgatatgcacaagaccacactaacaaagctagccaagcgtccgtcgtttggacgagctttttgccaatctaaaaagaagagtaaatttaatttgaatcatttggggtggttcatctaaattcaccgcgaggaacgacaaccctctgctatatggtatatctctcgatttgtttaagctggtgaagccgtcctgctgcctgccaaatagatagactctagcaactactgagttttaaaaagagaaacaaaattaaagaatgacaaccttttacggccaaaccccttttaacgtctggccaacgaatcttctcttcgacctgttttagcttgtgtccaaaatgctttccgtcgtagccctgcgttcgttactagataccgctcaccatttgatcttgattatgaaaacattgaccttatatatatatatatatatatatagccaagtattttttaatctaatatggaataagagaaaaactaatgtgcgtgcaactatcagaagcaaaattttctgtttttttcttctaacattgttgggtaaattagaattcaaaattttatgtatcggtatactatatattataataccctccagctcagattcaaatccgttttagataattaatagattcatacaacacttaatggtgtgtgtacatgttttatacacgtgtctagattcattatcatctatttgaatatagtagacataaaaatcaagatcaaaaccgaatactactttagcacggagtgagtaaaagtataagtataatattttttggggatatttgggatttttttaattttgattacacgacgattatattatattgtacggccggggaagcgttgattgtgcacagactgcatgccgtacaaactgcaagaataatcgtacatgtacatgcatgctgatgaactgaaagatcttgagctcgtggccctcctaatttgttaaataaaaatgcacatcggaaagcaacaaactgcaaatcacgccttacgcatgagatctcagattcccagcacgctctctctctctctctctgtctgcacatcacgtcacgtgtccctcccctcttgtgaattgatgcccggatcagcacactactggtagcagaaggtcccaaaactaagctatgcatgggcgggctacatacatacaccacccccatgctatttctagcagagtggctccaaacctcagcatccacagtacaggctacagcgtgtggttgtgatggtgaccacaagaatcctactacatgcatgctgatgatgtgctgcagtgaacactcactcactgcccatgaacagcgtctcctacctgccagccagtgccaagaacaatgaatgaatgattaactgctggcttcgcttgctgaaccattcccctcctcgtgtgcgcatgatgggcatgcagtggcggcgtcggtggggccgcgggagtggtacttcttcagcctcaaggaccgcaagtacgcgacggggcagcggacgaaccgggccacggtgtccgggtactggaaggcgacggggaaggaccgaccagtggtggcggcgcggcgaggcgcgctggtggggatgcgcaagacgctcgtgttctaccaggggagggcgcccaagggcaggaagacggagtgggtgatgcacgagtacaggatggagccagctgctcctcttcttgatcaccaaccctcctcatccaactccaaggtaaaatcggtcgatccattattcgatgaaacgacaagttaagactccattaattcgacgaactgaccgggggtgttttaactgtttcgttgtcgtccatcgatccttctcctgtcatcatgtcaccagcaggatgaagattgggtgctgtgcagagtcatctgcaagaagaaactggcagcaggaggccgcgcaggagggggcagctcgaggagcctggtcgccagcaacggcggccgcgagaccgcgccagccaccccgccgccgccgccgctgccacctcgcatggacacggacgccaccctagcacagctccaggccgccatgcacgccaccgccggcgcgctcgagcaggtgccctgcttctccagcttcaacaacaacactgccagctctagagctgctgccgcagcagcagcagcgcagccatgctacctgcccagcatggccacaggcggcagccacggcacgacgagctactacctagaccacgcgatgctgccgcctgagctgggtggctgcttcgatcctctccacggcgacaagaagctgctcaaggcggtgctgggccagctcggcggcgacgcggtggcgccgggcctgagcctgcagcacgagatggccgcgggcgctgtcgtcgcttcatccgcttggatgaatcacttctaggggacattagttcagcagcgaacctaagtatgtgattggttgcgtatattatgggaaatacatacatatatacataattgtgtggtgaaacatttgtgtgtgaggcaaggagtagagcatgcgtcatttttttggttgctgccgatcgatttggacgaaggccatgaggcaaggagtagaactctgtaatataatgatggctgctcaagtgtgtgtacacattcagatgcagaggtcgtatgtcatgagcgatgatcaggagaatttcagattggttattttactgtgcctgaactcaaccccaagatcacacttgacaccactcactcactcactcactcagagacacagtgcacattcatagaatcatcatggtaaacagacagaagacagaacagtggctgccaaacccaatcaatcatgccatttatgcaggaaagtaggcatgacagtcacatccgagcatctcttctttaccacaccatctttctttttccgatgtgtattgttgcgatgacaatcatgctaaccaagcagtcagctgagtgagggctcctgggcactggctttccactgcact

SEQ ID NO: 137 - DNA, 24662 bp, Artificial Sequence
  RV034409
gtttacccgccaatatatcctgtcaaacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgaattcgagctcggtacggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcctcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcggccatggcggcgcgcagctcttcagtgtctggaacgacacttaaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgaagcttgcatgcctgcatctagaactaccagcagcatgatcagagtgaggatagttgctacttcaatggcctaggtttgataactactgtcgatccatctgtcgacaattgtttgtttcctctcacaattcacgtttctgccgccacttctttgcacctaacattgcccgtgtcgctgttattagttttgtggttttgcattgtctgtatatagtctgatgaggctatagattgagccttcaaaagtgtttcgttgggcctcttgttgaatgtactccaaagtctcggtgcaccatcagacgtattcctagaatggcacaatctggctatcagaactggtaggtttagtccaaatgtaatgatgtgttctaaagtagtcgggctgagtcaaacagcagcttcttctcttgttcaaaattttgaacctggtaatgttgtcatttcatgatagatcatagatacattcttggtttcactatatcttagaaagtccagccaacagaagtactcaagtacaggtgaacctttcagtttagctggagacatgggcagcagtgtacaaagtctaatccacagctgtgaccctgtgagctgggggttgggcctgcctcggaggggatcgtgtcttttctgtttgtgcaattatcagtgcctaaagaacatgtgttataacagttatacacggtcaattattcaatccatcttttaacgtgtgtttggttgtacgtataagaagggatcaaagagggcggccacattttctataacatttggatgagagtcacacgagaacgagatgaacaccgaagtaattttttatgacagcatgatccaaaaaaatcgagagaacggtgttatccccgtctcatcctattttgatctcaaaccaaacacataattagtcaatgagcactgacttgatgtagaagaacttggtacatataccaggaaatgactctgacttgctgagatgccttgtagtccctcggtcccgtaaattatacagtagtatttaaacttcctcgcacaaaggaaaactatttgtttttgcatgccttgtaaattagctatcaagtttttttttaaaaaaaacgacctttgaaaaccagtaaggaggactcgttcggtattcagttttaaagttcaaggttaaaaatcgaactgacgtgcaaaacaccctgggggttaaaatcaaaacacacaaatttggaaaatgagcaggcatgacttatgttgtgtccgttgaagtgccgtggctccatggcacggtggaactttacattagtgcggtagtgtcactgtggcagtaaagcccacttattttccattagagagagggagattaaaaacgtggctttacacattctgaaactaattgtgagtttgtgactcttggcttgcctgcagtgtccgcctgcaccttctataagtacagtcgcgagcctcagctatacaaaccaactagcgcatagtatctcctgagctccattcatcatcccaagtcttcactggtcttagatcacggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgtagttagcttaatcacctagagctcgctatggatcaggatgtggatgtgttcgttcgatcgtttccacgtccaatctcgctgaataaattgtctcgagaaagtttggctttgccgagataaataatagtgataattcttactcctgctacaaactgttttccttgaagcaactatgagcatcttccatagattcgcgacacgatttaaattttaaaaataacatttttaaaaaaatgtgtcacggttacacaactttttttttaacactagttgcgccccgcgtccaagcttactccctgaaattgcattcaaactctcgattcatgtctgcccttctcaccttctgtgtgcctgtgtgggctcgacgtctagtcgtcttcgactcttcgcctacatcagtcacctcctcacacgacgtgtctgcgacacaggccgcggcatagagcacgggcatgtagttttgaacaagtgcatgttgctacctcgactatgatcatgcaaaatattttttttattatttatagaggtttaaaataagacatggaataataagcctggtggccttgaagctggaagtgtagcatggtggaagtgcgggtttgacaggccgacagcgcagagcatatcgaaaatacagctgaaaaaagatccgattatacttgaaaaaaaggataatcaccgaagcaatggaaagctccattcctgtttcccggtggaagaaaaatttctagcctccatccctgcgaacacataggagaactttttatcccttcaccgataaatttatgcccgcgagaaatctgcaaatacaataaatacaaattaattatattaaattaatataaattgaaaaacaagatttaaaattataatagatttctactttagagttcagttagctattttataattagttgtattgaaattttagtaaaattttaacatatcaataagctaaaagaagattatggaacaagtatacggggaattgggggtagaccggttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgaaggggcttcggaggatgttttagagctagaaatagcaagttaaaataaggctagtccgttatcaacttgaaaaagtggcaccgagtcggtgctttttttttgcggccgcgaattctgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgaaggggcttcggaggatgttttagagctagaaatagcaagttaaaataaggctagtccgttatcaacttgaaaaagtggcaccgagtcggtgctttttttttgaattccaccggtgttaacggcaaacgctaattagtcactaggcccaggaaacactaactaagccctagcttatcctagcgcaacctagttaggtcttggttaccggcctagaaggccgatctcccgggcacccagctttcttgtacaaagtggccgttaacggatcggccagaatggcccggaccgaagctttgtacagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctagtatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 138 - DNA, 24077 bp, Artificial Sequence
  RA000007
gtttacccgccaatatatcctgtcaaacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgaattcgagctcggtacggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatgatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggataaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgaagcttgcatgcctgcatctagaactaccagcagcatgatcagagtgaggatagttgctacttcaatggcctaggtttgataactactgtcgatccatctgtcgacaattgtttgtttcctctcacaattcacgtttctgccgccacttctttgcacctaacattgcccgtgtcgctgttattagttttgtggttttgcattgtctgtatatagtctgatgaggctatagattgagccttcaaaagtgtttcgttgggcctcttgttgaatgtactccaaagtctcggtgcaccatcagacgtattcctagaatggcacaatctggctatcagaactggtaggtttagtccaaatgtaatgatgtgttctaaagtagtcgggctgagtcaaacagcagcttcttctcttgttcaaaattttgaacctggtaatgttgtcatttcatgatagatcatagatacattcttggtttcactatatcttagaaagtccagccaacagaagtactcaagtacaggtgaacctttcagtttagctggagacatgggcagcagtgtacaaagtctaatccacagctgtgaccctgtgagctgggggttgggcctgcctcggaggggatcgtgtcttttctgtttgtgcaattatcagtgcctaaagaacatgtgttataacagttatacacggtcaattattcaatccatcttttaacgtgtgtttggttgtacgtataagaagggatcaaagagggcggccacattttctataacatttggatgagagtcacacgagaacgagatgaacaccgaagtaattttttatgacagcatgatccaaaaaaatcgagagaacggtgttatccccgtctcatcctattttgatctcaaaccaaacacataattagtcaatgagcactgacttgatgtagaagaacttggtacatataccaggaaatgactctgacttgctgagatgccttgtagtccctcggtcccgtaaattatacagtagtatttaaacttcctcgcacaaaggaaaactatttgtttttgcatgccttgtaaattagctatcaagtttttttttaaaaaaaacgacctttgaaaaccagtaaggaggactcgttcggtattcagttttaaagttcaaggttaaaaatcgaactgacgtgcaaaacaccctgggggttaaaatcaaaacacacaaatttggaaaatgagcaggcatgacttatgttgtgtccgttgaagtgccgtggctccatggcacggtggaactttacattagtgcggtagtgtcactgtggcagtaaagcccacttattttccattagagagagggagattaaaaacgtggctttacacattctgaaactaattgtgagtttgtgactcttggcttgcctgcagtgtccgcctgcaccttctataagtacagtcgcgagcctcagctatacaaaccaactagcgcatagtatctcctgagctccattcatcatcccaagtcttcactggtcttagatcacggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgtagttagcttaatcacctagagctcgctatggatcaggatgtggatgtgttcgttcgatcgtttccacgtccaatctcgctgaataaattgtctcgagaaagtttggctttgccgagataaataatagtgataattcttactcctgctacaaactgttttccttgaagcaactatgagcatcttccatagattcgcgacacgatttaaattttaaaaataacatttttaaaaaaatgtgtcacggttacacaactttttttttaacactagttgcgccccgcgtccaagcttactccctgaaattgcattcaaactctcgattcatgtctgcccttctcaccttctgtgtgcctgtgtgggctcgacgtctagtcgtcttcgactcttcgcctacatcagtcacctcctcacacgacgtgtctgcgacacaggccgcggcatagagcacgggcatgtagttttgaacaagtgcatgttgctacctcgactatgatcatgcaaaatattttttttattatttatagaggtttaaaataagacatggaataataagcctggtggccttgaagctggaagtgtagcatggtggaagtgcgggtttgacaggccgacagcgcagagcatatcgaaaatacagctgaaaaaagatccgattatacttgaaaaaaaggataatcaccgaagcaatggaaagctccattcctgtttcccggtggaagaaaaatttctagcctccatccctgcgaacacataggagaactttttatcccttcaccgataaatttatgcccgcgagaaatctgcaaatacaataaatacaaattaattatattaaattaatataaattgaaaaacaagatttaaaattataatagatttctactttagagttcagttagctattttataattagttgtattgaaattttagtaaaattttaacatatcaataagctaaaagaagattatggaacaagtatacggggaattgggggtagaccggttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgaaggggcttcggaggatgttttagagctagaaatagcaagttaaaataaggctagtccgttatcaacttgaaaaagtggcaccgagtcggtgctttttttttgcggccgcgaattctgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgaaggggcttcggaggatgttttagagctagaaatagcaagttaaaataaggctagtccgttatcaacttgaaaaagtggcaccgagtcggtgctttttttttgaattccaccggtgttaacggcaaacgctaattagtcactaggcccaggaaacactaactaagccctagcttatcctagcgcaacctagttaggtcttggttaccggcctagaaggccgatctcccgggcacccagctttcttgtacaaagtggccgttaacggatcggccagaatggcccggaccgaagctttgtacagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctagtatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 139 - DNA, 24365 bp, Artificial Sequence
  RA000008
gtttacccgccaatatatcctgtcaaacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgaattcgagctcggtacggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatggcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcctcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggataaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgaagcttgcatgcctgcatctagaactaccagcagcatgatcagagtgaggatagttgctacttcaatggcctaggtttgataactactgtcgatccatctgtcgacaattgtttgtttcctctcacaattcacgtttctgccgccacttctttgcacctaacattgcccgtgtcgctgttattagttttgtggttttgcattgtctgtatatagtctgatgaggctatagattgagccttcaaaagtgtttcgttgggcctcttgttgaatgtactccaaagtctcggtgcaccatcagacgtattcctagaatggcacaatctggctatcagaactggtaggtttagtccaaatgtaatgatgtgttctaaagtagtcgggctgagtcaaacagcagcttcttctcttgttcaaaattttgaacctggtaatgttgtcatttcatgatagatcatagatacattcttggtttcactatatcttagaaagtccagccaacagaagtactcaagtacaggtgaacctttcagtttagctggagacatgggcagcagtgtacaaagtctaatccacagctgtgaccctgtgagctgggggttgggcctgcctcggaggggatcgtgtcttttctgtttgtgcaattatcagtgcctaaagaacatgtgttataacagttatacacggtcaattattcaatccatcttttaacgtgtgtttggttgtacgtataagaagggatcaaagagggcggccacattttctataacatttggatgagagtcacacgagaacgagatgaacaccgaagtaattttttatgacagcatgatccaaaaaaatcgagagaacggtgttatccccgtctcatcctattttgatctcaaaccaaacacataattagtcaatgagcactgacttgatgtagaagaacttggtacatataccaggaaatgactctgacttgctgagatgccttgtagtccctcggtcccgtaaattatacagtagtatttaaacttcctcgcacaaaggaaaactatttgtttttgcatgccttgtaaattagctatcaagtttttttttaaaaaaaacgacctttgaaaaccagtaaggaggactcgttcggtattcagttttaaagttcaaggttaaaaatcgaactgacgtgcaaaacaccctgggggttaaaatcaaaacacacaaatttggaaaatgagcaggcatgacttatgttgtgtccgttgaagtgccgtggctccatggcacggtggaactttacattagtgcggtagtgtcactgtggcagtaaagcccacttattttccattagagagagggagattaaaaacgtggctttacacattctgaaactaattgtgagtttgtgactcttggcttgcctgcagtgtccgcctgcaccttctataagtacagtcgcgagcctcagctatacaaaccaactagcgcatagtatctcctgagctccattcatcatcccaagtcttcactggtcttagatcacggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgtagttagcttaatcacctagagctcgctatggatcaggatgtggatgtgttcgttcgatcgtttccacgtccaatctcgctgaataaattgtctcgagaaagtttggctttgccgagataaataatagtgataattcttactcctgctacaaactgttttccttgaagcaactatgagcatcttccatagattcgcgacacgatttaaattttaaaaataacatttttaaaaaaatgtgtcacggttacacaactttttttttaacactagttgcgccccgcgtccaagcttactccctgaaattgcattcaaactctcgattcatgtctgcccttctcaccttctgtgtgcctgtgtgggctcgacgtctagtcgtcttcgactcttcgcctacatcagtcacctcctcacacgacgtgtctgcgacacaggccgcggcatagagcacgggcatgtagttttgaacaagtgcatgttgctacctcgactatgatcatgcaaaatattttttttattatttatagaggtttaaaataagacatggaataataagcctggtggccttgaagctggaagtgtagcatggtggaagtgcgggtttgacaggccgacagcgcagagcatatcgaaaatacagctgaaaaaagatccgattatacttgaaaaaaaggataatcaccgaagcaatggaaagctccattcctgtttcccggtggaagaaaaatttctagcctccatccctgcgaacacataggagaactttttatcccttcaccgataaatttatgcccgcgagaaatctgcaaatacaataaatacaaattaattatattaaattaatataaattgaaaaacaagatttaaaattataatagatttctactttagagttcagttagctattttataattagttgtattgaaattttagtaaaattttaacatatcaataagctaaaagaagattatggaacaagtatacggggaattgggggtagaccggttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgaaggggcttcggaggatgttttagagctagaaatagcaagttaaaataaggctagtccgttatcaacttgaaaaagtggcaccgagtcggtgctttttttttgcggccgcgaattctgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgaaggggcttcggaggatgttttagagctagaaatagcaagttaaaataaggctagtccgttatcaacttgaaaaagtggcaccgagtcggtgctttttttttgaattccaccggtgttaacggcaaacgctaattagtcactaggcccaggaaacactaactaagccctagcttatcctagcgcaacctagttaggtcttggttaccggcctagaaggccgatctcccgggcacccagctttcttgtacaaagtggccgttaacggatcggccagaatggcccggaccgaagctttgtacagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctagtatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 140 - DNA, 23852 bp, Artificial Sequence
  RA000009
gtttacccgccaatatatcctgtcaaacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgaattcgagctcggtacggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggataaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgaagcttgcatgcctgcatctagaactaccagcagcatgatcagagtgaggatagttgctacttcaatggcctaggtttgataactactgtcgatccatctgtcgacaattgtttgtttcctctcacaattcacgtttctgccgccacttctttgcacctaacattgcccgtgtcgctgttattagttttgtggttttgcattgtctgtatatagtctgatgaggctatagattgagccttcaaaagtgtttcgttgggcctcttgttgaatgtactccaaagtctcggtgcaccatcagacgtattcctagaatggcacaatctggctatcagaactggtaggtttagtccaaatgtaatgatgtgttctaaagtagtcgggctgagtcaaacagcagcttcttctcttgttcaaaattttgaacctggtaatgttgtcatttcatgatagatcatagatacattcttggtttcactatatcttagaaagtccagccaacagaagtactcaagtacaggtgaacctttcagtttagctggagacatgggcagcagtgtacaaagtctaatccacagctgtgaccctgtgagctgggggttgggcctgcctcggaggggatcgtgtcttttctgtttgtgcaattatcagtgcctaaagaacatgtgttataacagttatacacggtcaattattcaatccatcttttaacgtgtgtttggttgtacgtataagaagggatcaaagagggcggccacattttctataacatttggatgagagtcacacgagaacgagatgaacaccgaagtaattttttatgacagcatgatccaaaaaaatcgagagaacggtgttatccccgtctcatcctattttgatctcaaaccaaacacataattagtcaatgagcactgacttgatgtagaagaacttggtacatataccaggaaatgactctgacttgctgagatgccttgtagtccctcggtcccgtaaattatacagtagtatttaaacttcctcgcacaaaggaaaactatttgtttttgcatgccttgtaaattagctatcaagtttttttttaaaaaaaacgacctttgaaaaccagtaaggaggactcgttcggtattcagttttaaagttcaaggttaaaaatcgaactgacgtgcaaaacaccctgggggttaaaatcaaaacacacaaatttggaaaatgagcaggcatgacttatgttgtgtccgttgaagtgccgtggctccatggcacggtggaactttacattagtgcggtagtgtcactgtggcagtaaagcccacttattttccattagagagagggagattaaaaacgtggctttacacattctgaaactaattgtgagtttgtgactcttggcttgcctgcagtgtccgcctgcaccttctataagtacagtcgcgagcctcagctatacaaaccaactagcgcatagtatctcctgagctccattcatcatcccaagtcttcactggtcttagatcacggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgtagttagcttaatcacctagagctcgctatggatcaggatgtggatgtgttcgttcgatcgtttccacgtccaatctcgctgaataaattgtctcgagaaagtttggctttgccgagataaataatagtgataattcttactcctgctacaaactgttttccttgaagcaactatgagcatcttccatagattcgcgacacgatttaaattttaaaaataacatttttaaaaaaatgtgtcacggttacacaactttttttttaacactagttgcgccccgcgtccaagcttactccctgaaattgcattcaaactctcgattcatgtctgcccttctcaccttctgtgtgcctgtgtgggctcgacgtctagtcgtcttcgactcttcgcctacatcagtcacctcctcacacgacgtgtctgcgacacaggccgcggcatagagcacgggcatgtagttttgaacaagtgcatgttgctacctcgactatgatcatgcaaaatattttttttattatttatagaggtttaaaataagacatggaataataagcctggtggccttgaagctggaagtgtagcatggtggaagtgcgggtttgacaggccgacagcgcagagcatatcgaaaatacagctgaaaaaagatccgattatacttgaaaaaaaggataatcaccgaagcaatggaaagctccattcctgtttcccggtggaagaaaaatttctagcctccatccctgcgaacacataggagaactttttatcccttcaccgataaatttatgcccgcgagaaatctgcaaatacaataaatacaaattaattatattaaattaatataaattgaaaaacaagatttaaaattataatagatttctactttagagttcagttagctattttataattagttgtattgaaattttagtaaaattttaacatatcaataagctaaaagaagattatggaacaagtatacggggaattgggggtagaccggttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgaaggggcttcggaggatgttttagagctagaaatagcaagttaaaataaggctagtccgttatcaacttgaaaaagtggcaccgagtcggtgctttttttttgcggccgcgaattctgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgaaggggcttcggaggatgttttagagctagaaatagcaagttaaaataaggctagtccgttatcaacttgaaaaagtggcaccgagtcggtgctttttttttgaattccaccggtgttaacggcaaacgctaattagtcactaggcccaggaaacactaactaagccctagcttatcctagcgcaacctagttaggtcttggttaccggcctagaaggccgatctcccgggcacccagctttcttgtacaaagtggccgttaacggatcggccagaatggcccggaccgaagctttgtacagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctagtatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 141 - DNA, 23837 bp, Artificial Sequence
  RA000010
gtttacccgccaatatatcctgtcaaacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgaattcgagctcggtacggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatgatcgggctgtccatgattaagaactggctgcggagccaaccggcgcccggtggaggcggcagcggtggcggaggctccggaggcggtggcgacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggataaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgaagcttgcatgcctgcatctagaactaccagcagcatgatcagagtgaggatagttgctacttcaatggcctaggtttgataactactgtcgatccatctgtcgacaattgtttgtttcctctcacaattcacgtttctgccgccacttctttgcacctaacattgcccgtgtcgctgttattagttttgtggttttgcattgtctgtatatagtctgatgaggctatagattgagccttcaaaagtgtttcgttgggcctcttgttgaatgtactccaaagtctcggtgcaccatcagacgtattcctagaatggcacaatctggctatcagaactggtaggtttagtccaaatgtaatgatgtgttctaaagtagtcgggctgagtcaaacagcagcttcttctcttgttcaaaattttgaacctggtaatgttgtcatttcatgatagatcatagatacattcttggtttcactatatcttagaaagtccagccaacagaagtactcaagtacaggtgaacctttcagtttagctggagacatgggcagcagtgtacaaagtctaatccacagctgtgaccctgtgagctgggggttgggcctgcctcggaggggatcgtgtcttttctgtttgtgcaattatcagtgcctaaagaacatgtgttataacagttatacacggtcaattattcaatccatcttttaacgtgtgtttggttgtacgtataagaagggatcaaagagggcggccacattttctataacatttggatgagagtcacacgagaacgagatgaacaccgaagtaattttttatgacagcatgatccaaaaaaatcgagagaacggtgttatccccgtctcatcctattttgatctcaaaccaaacacataattagtcaatgagcactgacttgatgtagaagaacttggtacatataccaggaaatgactctgacttgctgagatgccttgtagtccctcggtcccgtaaattatacagtagtatttaaacttcctcgcacaaaggaaaactatttgtttttgcatgccttgtaaattagctatcaagtttttttttaaaaaaaacgacctttgaaaaccagtaaggaggactcgttcggtattcagttttaaagttcaaggttaaaaatcgaactgacgtgcaaaacaccctgggggttaaaatcaaaacacacaaatttggaaaatgagcaggcatgacttatgttgtgtccgttgaagtgccgtggctccatggcacggtggaactttacattagtgcggtagtgtcactgtggcagtaaagcccacttattttccattagagagagggagattaaaaacgtggctttacacattctgaaactaattgtgagtttgtgactcttggcttgcctgcagtgtccgcctgcaccttctataagtacagtcgcgagcctcagctatacaaaccaactagcgcatagtatctcctgagctccattcatcatcccaagtcttcactggtcttagatcacggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgtagttagcttaatcacctagagctcgctatggatcaggatgtggatgtgttcgttcgatcgtttccacgtccaatctcgctgaataaattgtctcgagaaagtttggctttgccgagataaataatagtgataattcttactcctgctacaaactgttttccttgaagcaactatgagcatcttccatagattcgcgacacgatttaaattttaaaaataacatttttaaaaaaatgtgtcacggttacacaactttttttttaacactagttgcgccccgcgtccaagcttactccctgaaattgcattcaaactctcgattcatgtctgcccttctcaccttctgtgtgcctgtgtgggctcgacgtctagtcgtcttcgactcttcgcctacatcagtcacctcctcacacgacgtgtctgcgacacaggccgcggcatagagcacgggcatgtagttttgaacaagtgcatgttgctacctcgactatgatcatgcaaaatattttttttattatttatagaggtttaaaataagacatggaataataagcctggtggccttgaagctggaagtgtagcatggtggaagtgcgggtttgacaggccgacagcgcagagcatatcgaaaatacagctgaaaaaagatccgattatacttgaaaaaaaggataatcaccgaagcaatggaaagctccattcctgtttcccggtggaagaaaaatttctagcctccatccctgcgaacacataggagaactttttatcccttcaccgataaatttatgcccgcgagaaatctgcaaatacaataaatacaaattaattatattaaattaatataaattgaaaaacaagatttaaaattataatagatttctactttagagttcagttagctattttataattagttgtattgaaattttagtaaaattttaacatatcaataagctaaaagaagattatggaacaagtatacggggaattgggggtagaccggttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgaaggggcttcggaggatgttttagagctagaaatagcaagttaaaataaggctagtccgttatcaacttgaaaaagtggcaccgagtcggtgctttttttttgcggccgcgaattctgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgaaggggcttcggaggatgttttagagctagaaatagcaagttaaaataaggctagtccgttatcaacttgaaaaagtggcaccgagtcggtgctttttttttgaattccaccggtgttaacggcaaacgctaattagtcactaggcccaggaaacactaactaagccctagcttatcctagcgcaacctagttaggtcttggttaccggcctagaaggccgatctcccgggcacccagctttcttgtacaaagtggccgttaacggatcggccagaatggcccggaccgaagctttgtacagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctagtatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 142 - DNA, 23819 bp, Artificial Sequence
  RA000011
gtttacccgccaatatatcctgtcaaacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgaattcgagctcggtacggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatggcggagccgaagctggaggacttcctcggcggtggaggcggcagcggtggcggaggctccggaggcggtggcgacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggataaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgaagcttgcatgcctgcatctagaactaccagcagcatgatcagagtgaggatagttgctacttcaatggcctaggtttgataactactgtcgatccatctgtcgacaattgtttgtttcctctcacaattcacgtttctgccgccacttctttgcacctaacattgcccgtgtcgctgttattagttttgtggttttgcattgtctgtatatagtctgatgaggctatagattgagccttcaaaagtgtttcgttgggcctcttgttgaatgtactccaaagtctcggtgcaccatcagacgtattcctagaatggcacaatctggctatcagaactggtaggtttagtccaaatgtaatgatgtgttctaaagtagtcgggctgagtcaaacagcagcttcttctcttgttcaaaattttgaacctggtaatgttgtcatttcatgatagatcatagatacattcttggtttcactatatcttagaaagtccagccaacagaagtactcaagtacaggtgaacctttcagtttagctggagacatgggcagcagtgtacaaagtctaatccacagctgtgaccctgtgagctgggggttgggcctgcctcggaggggatcgtgtcttttctgtttgtgcaattatcagtgcctaaagaacatgtgttataacagttatacacggtcaattattcaatccatcttttaacgtgtgtttggttgtacgtataagaagggatcaaagagggcggccacattttctataacatttggatgagagtcacacgagaacgagatgaacaccgaagtaattttttatgacagcatgatccaaaaaaatcgagagaacggtgttatccccgtctcatcctattttgatctcaaaccaaacacataattagtcaatgagcactgacttgatgtagaagaacttggtacatataccaggaaatgactctgacttgctgagatgccttgtagtccctcggtcccgtaaattatacagtagtatttaaacttcctcgcacaaaggaaaactatttgtttttgcatgccttgtaaattagctatcaagtttttttttaaaaaaaacgacctttgaaaaccagtaaggaggactcgttcggtattcagttttaaagttcaaggttaaaaatcgaactgacgtgcaaaacaccctgggggttaaaatcaaaacacacaaatttggaaaatgagcaggcatgacttatgttgtgtccgttgaagtgccgtggctccatggcacggtggaactttacattagtgcggtagtgtcactgtggcagtaaagcccacttattttccattagagagagggagattaaaaacgtggctttacacattctgaaactaattgtgagtttgtgactcttggcttgcctgcagtgtccgcctgcaccttctataagtacagtcgcgagcctcagctatacaaaccaactagcgcatagtatctcctgagctccattcatcatcccaagtcttcactggtcttagatcacggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgtagttagcttaatcacctagagctcgctatggatcaggatgtggatgtgttcgttcgatcgtttccacgtccaatctcgctgaataaattgtctcgagaaagtttggctttgccgagataaataatagtgataattcttactcctgctacaaactgttttccttgaagcaactatgagcatcttccatagattcgcgacacgatttaaattttaaaaataacatttttaaaaaaatgtgtcacggttacacaactttttttttaacactagttgcgccccgcgtccaagcttactccctgaaattgcattcaaactctcgattcatgtctgcccttctcaccttctgtgtgcctgtgtgggctcgacgtctagtcgtcttcgactcttcgcctacatcagtcacctcctcacacgacgtgtctgcgacacaggccgcggcatagagcacgggcatgtagttttgaacaagtgcatgttgctacctcgactatgatcatgcaaaatattttttttattatttatagaggtttaaaataagacatggaataataagcctggtggccttgaagctggaagtgtagcatggtggaagtgcgggtttgacaggccgacagcgcagagcatatcgaaaatacagctgaaaaaagatccgattatacttgaaaaaaaggataatcaccgaagcaatggaaagctccattcctgtttcccggtggaagaaaaatttctagcctccatccctgcgaacacataggagaactttttatcccttcaccgataaatttatgcccgcgagaaatctgcaaatacaataaatacaaattaattatattaaattaatataaattgaaaaacaagatttaaaattataatagatttctactttagagttcagttagctattttataattagttgtattgaaattttagtaaaattttaacatatcaataagctaaaagaagattatggaacaagtatacggggaattgggggtagaccggttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgaaggggcttcggaggatgttttagagctagaaatagcaagttaaaataaggctagtccgttatcaacttgaaaaagtggcaccgagtcggtgctttttttttgcggccgcgaattctgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgaaggggcttcggaggatgttttagagctagaaatagcaagttaaaataaggctagtccgttatcaacttgaaaaagtggcaccgagtcggtgctttttttttgaattccaccggtgttaacggcaaacgctaattagtcactaggcccaggaaacactaactaagccctagcttatcctagcgcaacctagttaggtcttggttaccggcctagaaggccgatctcccgggcacccagctttcttgtacaaagtggccgttaacggatcggccagaatggcccggaccgaagctttgtacagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctagtatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 143 - DNA, 23909 bp, Artificial Sequence
  RA000012
gtttacccgccaatatatcctgtcaaacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgaattcgagctcggtacggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatggcggagccgaagctggaggacttcctcggcggtggaggcggcagcggtggcggaggctccggaggcggtggcatcgggctgtccatgattaagaactggctgcggagccaaccggcgcccggtggaggcggcagcggtggcggaggctccggaggcggtggcgacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggataaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgaagcttgcatgcctgcatctagaactaccagcagcatgatcagagtgaggatagttgctacttcaatggcctaggtttgataactactgtcgatccatctgtcgacaattgtttgtttcctctcacaattcacgtttctgccgccacttctttgcacctaacattgcccgtgtcgctgttattagttttgtggttttgcattgtctgtatatagtctgatgaggctatagattgagccttcaaaagtgtttcgttgggcctcttgttgaatgtactccaaagtctcggtgcaccatcagacgtattcctagaatggcacaatctggctatcagaactggtaggtttagtccaaatgtaatgatgtgttctaaagtagtcgggctgagtcaaacagcagcttcttctcttgttcaaaattttgaacctggtaatgttgtcatttcatgatagatcatagatacattcttggtttcactatatcttagaaagtccagccaacagaagtactcaagtacaggtgaacctttcagtttagctggagacatgggcagcagtgtacaaagtctaatccacagctgtgaccctgtgagctgggggttgggcctgcctcggaggggatcgtgtcttttctgtttgtgcaattatcagtgcctaaagaacatgtgttataacagttatacacggtcaattattcaatccatcttttaacgtgtgtttggttgtacgtataagaagggatcaaagagggcggccacattttctataacatttggatgagagtcacacgagaacgagatgaacaccgaagtaattttttatgacagcatgatccaaaaaaatcgagagaacggtgttatccccgtctcatcctattttgatctcaaaccaaacacataattagtcaatgagcactgacttgatgtagaagaacttggtacatataccaggaaatgactctgacttgctgagatgccttgtagtccctcggtcccgtaaattatacagtagtatttaaacttcctcgcacaaaggaaaactatttgtttttgcatgccttgtaaattagctatcaagtttttttttaaaaaaaacgacctttgaaaaccagtaaggaggactcgttcggtattcagttttaaagttcaaggttaaaaatcgaactgacgtgcaaaacaccctgggggttaaaatcaaaacacacaaatttggaaaatgagcaggcatgacttatgttgtgtccgttgaagtgccgtggctccatggcacggtggaactttacattagtgcggtagtgtcactgtggcagtaaagcccacttattttccattagagagagggagattaaaaacgtggctttacacattctgaaactaattgtgagtttgtgactcttggcttgcctgcagtgtccgcctgcaccttctataagtacagtcgcgagcctcagctatacaaaccaactagcgcatagtatctcctgagctccattcatcatcccaagtcttcactggtcttagatcacggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgtagttagcttaatcacctagagctcgctatggatcaggatgtggatgtgttcgttcgatcgtttccacgtccaatctcgctgaataaattgtctcgagaaagtttggctttgccgagataaataatagtgataattcttactcctgctacaaactgttttccttgaagcaactatgagcatcttccatagattcgcgacacgatttaaattttaaaaataacatttttaaaaaaatgtgtcacggttacacaactttttttttaacactagttgcgccccgcgtccaagcttactccctgaaattgcattcaaactctcgattcatgtctgcccttctcaccttctgtgtgcctgtgtgggctcgacgtctagtcgtcttcgactcttcgcctacatcagtcacctcctcacacgacgtgtctgcgacacaggccgcggcatagagcacgggcatgtagttttgaacaagtgcatgttgctacctcgactatgatcatgcaaaatattttttttattatttatagaggtttaaaataagacatggaataataagcctggtggccttgaagctggaagtgtagcatggtggaagtgcgggtttgacaggccgacagcgcagagcatatcgaaaatacagctgaaaaaagatccgattatacttgaaaaaaaggataatcaccgaagcaatggaaagctccattcctgtttcccggtggaagaaaaatttctagcctccatccctgcgaacacataggagaactttttatcccttcaccgataaatttatgcccgcgagaaatctgcaaatacaataaatacaaattaattatattaaattaatataaattgaaaaacaagatttaaaattataatagatttctactttagagttcagttagctattttataattagttgtattgaaattttagtaaaattttaacatatcaataagctaaaagaagattatggaacaagtatacggggaattgggggtagaccggttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgaaggggcttcggaggatgttttagagctagaaatagcaagttaaaataaggctagtccgttatcaacttgaaaaagtggcaccgagtcggtgctttttttttgcggccgcgaattctgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgaaggggcttcggaggatgttttagagctagaaatagcaagttaaaataaggctagtccgttatcaacttgaaaaagtggcaccgagtcggtgctttttttttgaattccaccggtgttaacggcaaacgctaattagtcactaggcccaggaaacactaactaagccctagcttatcctagcgcaacctagttaggtcttggttaccggcctagaaggccgatctcccgggcacccagctttcttgtacaaagtggccgttaacggatcggccagaatggcccggaccgaagctttgtacagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctagtatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 144 - DNA, 24515 bp, Artificial Sequence
  PHP97131
gtttacccgccaatatatcctgtcaaacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgaattcgagctcggtacggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcctcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcggccatggcggcgcgcagctcttcagtgtctggaacgacacttaaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgaagcttgcatgcctgcatctagaactaccagcagcatgatcagagtgaggatagttgctacttcaatggcctaggtttgataactactgtcgatccatctgtcgacaattgtttgtttcctctcacaattcacgtttctgccgccacttctttgcacctaacattgcccgtgtcgctgttattagttttgtggttttgcattgtctgtatatagtctgatgaggctatagattgagccttcaaaagtgtttcgttgggcctcttgttgaatgtactccaaagtctcggtgcaccatcagacgtattcctagaatggcacaatctggctatcagaactggtaggtttagtccaaatgtaatgatgtgttctaaagtagtcgggctgagtcaaacagcagcttcttctcttgttcaaaattttgaacctggtaatgttgtcatttcatgatagatcatagatacattcttggtttcactatatcttagaaagtccagccaacagaagtactcaagtacaggtgaacctttcagtttagctggagacatgggcagcagtgtacaaagtctaatccacagctgtgaccctgtgagctgggggttgggcctgcctcggaggggatcgtgtcttttctgtttgtgcaattatcagtgcctaaagaacatgtgttataacagttatacacggtcaattattcaatccatcttttaacgtgtgtttggttgtacgtataagaagggatcaaagagggcggccacattttctataacatttggatgagagtcacacgagaacgagatgaacaccgaagtaattttttatgacagcatgatccaaaaaaatcgagagaacggtgttatccccgtctcatcctattttgatctcaaaccaaacacataattagtcaatgagcactgacttgatgtagaagaacttggtacatataccaggaaatgactctgacttgctgagatgccttgtagtccctcggtcccgtaaattatacagtagtatttaaacttcctcgcacaaaggaaaactatttgtttttgcatgccttgtaaattagctatcaagtttttttttaaaaaaaacgacctttgaaaaccagtaaggaggactcgttcggtattcagttttaaagttcaaggttaaaaatcgaactgacgtgcaaaacaccctgggggttaaaatcaaaacacacaaatttggaaaatgagcaggcatgacttatgttgtgtccgttgaagtgccgtggctccatggcacggtggaactttacattagtgcggtagtgtcactgtggcagtaaagcccacttattttccattagagagagggagattaaaaacgtggctttacacattctgaaactaattgtgagtttgtgactcttggcttgcctgcagtgtccgcctgcaccttctataagtacagtcgcgagcctcagctatacaaaccaactagcgcatagtatctcctgagctccattcatcatcccaagtcttcactggtcttagatcacggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgtagttagcttaatcacctagagctcgctatggatcaggatgtggatgtgttcgttcgatcgtttccacgtccaatctcgctgaataaattgtctcgagaaagtttggctttgccgagataaataatagtgataattcttactcctgctacaaactgttttccttgaagcaactatgagcatcttccatagattcgcgacacgatttaaattttaaaaataacatttttaaaaaaatgtgtcacggttacacaactttttttttaacactagttgcgccccgcgtccaagcttactccctgaaattgcattcaaactctcgattcatgtctgcccttctcaccttctgtgtgcctgtgtgggctcgacgtctagtcgtcttcgactcttcgcctacatcagtcacctcctcacacgacgtgtctgcgacacaggccgcggcatagagcacgggcatgtagttttgaacaagtgcatgttgctacctcgactatgatcatgcaaaatattttttttattatttatagaggtttaaaataagacatggaataataagcctggtggccttgaagctggaagtgtagcatggtggaagtgcgggtttgacaggccgacagcgcagagcatatcgaaaatacagctgaaaaaagatccgattatacttgaaaaaaaggataatcaccgaagcaatggaaagctccattcctgtttcccggtggaagaaaaatttctagcctccatccctgcgaacacataggagaactttttatcccttcaccgataaatttatgcccgcgagaaatctgcaaatacaataaatacaaattaattatattaaattaatataaattgaaaaacaagatttaaaattataatagatttctactttagagttcagttagctattttataattagttgtattgaaattttagtaaaattttaacatatcaataagctaaaagaagattatggaacaagtatacggggaattgggggtagaccggttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgcataatgaggatcgaggatggttttagagctagaaatagcaagttaaaataaggctagtccgttatcaacttgaaaaagtggcaccgagtcggtgctttttttttgcggccgcgaattccaccggtgttaacggcaaacgctaattagtcactaggcccaggaaacactaactaagccctagcttatcctagcgcaacctagttaggtcttggttaccggcctagaaggccgatctcccgggtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcccgggcacccagctttcttgtacaaagtggccgttaacggatcggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctagtatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcgggcataatgaggatcgaggatgaggggccgccggatagatggcgtctagcatatcgataggacatgacaagtggtacgatccccgtcacatgtccatggaggcatctgatatggacacggcgtgtatctatcgcggctggaacagaaccagcgctcgcgcggcggtcggcgggagggacagaccttggctccgtgcgttcaggttgtgcttgtgccgcgcgccacgcacggtctccgccgcctgcagctgaaattttagatttacatcctatccctttattttttttatttgtcacaattcagttcaaaaatgaagaacggaggtagtgcatcctttgtgagactaatgaaaatcacatctggatcctgaaatcggcgtcgtaacctacaaggccacggactggattagatagtggtccatggtgcataatgaggatcgaggggtaccggtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctagggaagttcctattccgaagttcctattctctagaaagtataggaacttcagatccaccgggatccaccatggttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggatccaccatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcaccggtgccatgaggagcaatcattgttcaagacatgatgcaaagctagaaaactttgattgtggccgtcctaattgtgaagtttaggccggggggaacttcatgaaccctatcgaagcttaattagttcttttttgttgttagccatgtttgtattgtagtttaggtgaacaacatgacgccgcacccgcgatctcagggctcgtccccacacaggagggcacgtcgtcgtcttcgccgccgagcatcagagattcagagcacgtacacgcacatctcaagcaaacggagtagtacgtcctactcctacgtacatacctagccgacgacctttatgtgcacaccaccactgctctgctgcccggcctctccgtcgtccgttcatcaccagctggtctggtccttcaatttccatgcgtcggtccgcccgcataatgaggatcgaggatgaggcccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 145 - DNA, 23930 bp, Artificial Sequence
  RC000019
gtttacccgccaatatatcctgtcaaacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgaattcgagctcggtacggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatgatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggataaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgaagcttgcatgcctgcatctagaactaccagcagcatgatcagagtgaggatagttgctacttcaatggcctaggtttgataactactgtcgatccatctgtcgacaattgtttgtttcctctcacaattcacgtttctgccgccacttctttgcacctaacattgcccgtgtcgctgttattagttttgtggttttgcattgtctgtatatagtctgatgaggctatagattgagccttcaaaagtgtttcgttgggcctcttgttgaatgtactccaaagtctcggtgcaccatcagacgtattcctagaatggcacaatctggctatcagaactggtaggtttagtccaaatgtaatgatgtgttctaaagtagtcgggctgagtcaaacagcagcttcttctcttgttcaaaattttgaacctggtaatgttgtcatttcatgatagatcatagatacattcttggtttcactatatcttagaaagtccagccaacagaagtactcaagtacaggtgaacctttcagtttagctggagacatgggcagcagtgtacaaagtctaatccacagctgtgaccctgtgagctgggggttgggcctgcctcggaggggatcgtgtcttttctgtttgtgcaattatcagtgcctaaagaacatgtgttataacagttatacacggtcaattattcaatccatcttttaacgtgtgtttggttgtacgtataagaagggatcaaagagggcggccacattttctataacatttggatgagagtcacacgagaacgagatgaacaccgaagtaattttttatgacagcatgatccaaaaaaatcgagagaacggtgttatccccgtctcatcctattttgatctcaaaccaaacacataattagtcaatgagcactgacttgatgtagaagaacttggtacatataccaggaaatgactctgacttgctgagatgccttgtagtccctcggtcccgtaaattatacagtagtatttaaacttcctcgcacaaaggaaaactatttgtttttgcatgccttgtaaattagctatcaagtttttttttaaaaaaaacgacctttgaaaaccagtaaggaggactcgttcggtattcagttttaaagttcaaggttaaaaatcgaactgacgtgcaaaacaccctgggggttaaaatcaaaacacacaaatttggaaaatgagcaggcatgacttatgttgtgtccgttgaagtgccgtggctccatggcacggtggaactttacattagtgcggtagtgtcactgtggcagtaaagcccacttattttccattagagagagggagattaaaaacgtggctttacacattctgaaactaattgtgagtttgtgactcttggcttgcctgcagtgtccgcctgcaccttctataagtacagtcgcgagcctcagctatacaaaccaactagcgcatagtatctcctgagctccattcatcatcccaagtcttcactggtcttagatcacggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgtagttagcttaatcacctagagctcgctatggatcaggatgtggatgtgttcgttcgatcgtttccacgtccaatctcgctgaataaattgtctcgagaaagtttggctttgccgagataaataatagtgataattcttactcctgctacaaactgttttccttgaagcaactatgagcatcttccatagattcgcgacacgatttaaattttaaaaataacatttttaaaaaaatgtgtcacggttacacaactttttttttaacactagttgcgccccgcgtccaagcttactccctgaaattgcattcaaactctcgattcatgtctgcccttctcaccttctgtgtgcctgtgtgggctcgacgtctagtcgtcttcgactcttcgcctacatcagtcacctcctcacacgacgtgtctgcgacacaggccgcggcatagagcacgggcatgtagttttgaacaagtgcatgttgctacctcgactatgatcatgcaaaatattttttttattatttatagaggtttaaaataagacatggaataataagcctggtggccttgaagctggaagtgtagcatggtggaagtgcgggtttgacaggccgacagcgcagagcatatcgaaaatacagctgaaaaaagatccgattatacttgaaaaaaaggataatcaccgaagcaatggaaagctccattcctgtttcccggtggaagaaaaatttctagcctccatccctgcgaacacataggagaactttttatcccttcaccgataaatttatgcccgcgagaaatctgcaaatacaataaatacaaattaattatattaaattaatataaattgaaaaacaagatttaaaattataatagatttctactttagagttcagttagctattttataattagttgtattgaaattttagtaaaattttaacatatcaataagctaaaagaagattatggaacaagtatacggggaattgggggtagaccggttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgcataatgaggatcgaggatggttttagagctagaaatagcaagttaaaataaggctagtccgttatcaacttgaaaaagtggcaccgagtcggtgctttttttttgcggccgcgaattccaccggtgttaacggcaaacgctaattagtcactaggcccaggaaacactaactaagccctagcttatcctagcgcaacctagttaggtcttggttaccggcctagaaggccgatctcccgggtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcccgggcacccagctttcttgtacaaagtggccgttaacggatcggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctagtatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcgggcataatgaggatcgaggatgaggggccgccggatagatggcgtctagcatatcgataggacatgacaagtggtacgatccccgtcacatgtccatggaggcatctgatatggacacggcgtgtatctatcgcggctggaacagaaccagcgctcgcgcggcggtcggcgggagggacagaccttggctccgtgcgttcaggttgtgcttgtgccgcgcgccacgcacggtctccgccgcctgcagctgaaattttagatttacatcctatccctttattttttttatttgtcacaattcagttcaaaaatgaagaacggaggtagtgcatcctttgtgagactaatgaaaatcacatctggatcctgaaatcggcgtcgtaacctacaaggccacggactggattagatagtggtccatggtgcataatgaggatcgaggggtaccggtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctagggaagttcctattccgaagttcctattctctagaaagtataggaacttcagatccaccgggatccaccatggttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggatccaccatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcaccggtgccatgaggagcaatcattgttcaagacatgatgcaaagctagaaaactttgattgtggccgtcctaattgtgaagtttaggccggggggaacttcatgaaccctatcgaagcttaattagttcttttttgttgttagccatgtttgtattgtagtttaggtgaacaacatgacgccgcacccgcgatctcagggctcgtccccacacaggagggcacgtcgtcgtcttcgccgccgagcatcagagattcagagcacgtacacgcacatctcaagcaaacggagtagtacgtcctactcctacgtacatacctagccgacgacctttatgtgcacaccaccactgctctgctgcccggcctctccgtcgtccgttcatcaccagctggtctggtccttcaatttccatgcgtcggtccgcccgcataatgaggatcgaggatgaggcccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 146 - DNA, 24218 bp, Artificial Sequence
  RC000020
gtttacccgccaatatatcctgtcaaacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgaattcgagctcggtacggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatggcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcctcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggataaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgaagcttgcatgcctgcatctagaactaccagcagcatgatcagagtgaggatagttgctacttcaatggcctaggtttgataactactgtcgatccatctgtcgacaattgtttgtttcctctcacaattcacgtttctgccgccacttctttgcacctaacattgcccgtgtcgctgttattagttttgtggttttgcattgtctgtatatagtctgatgaggctatagattgagccttcaaaagtgtttcgttgggcctcttgttgaatgtactccaaagtctcggtgcaccatcagacgtattcctagaatggcacaatctggctatcagaactggtaggtttagtccaaatgtaatgatgtgttctaaagtagtcgggctgagtcaaacagcagcttcttctcttgttcaaaattttgaacctggtaatgttgtcatttcatgatagatcatagatacattcttggtttcactatatcttagaaagtccagccaacagaagtactcaagtacaggtgaacctttcagtttagctggagacatgggcagcagtgtacaaagtctaatccacagctgtgaccctgtgagctgggggttgggcctgcctcggaggggatcgtgtcttttctgtttgtgcaattatcagtgcctaaagaacatgtgttataacagttatacacggtcaattattcaatccatcttttaacgtgtgtttggttgtacgtataagaagggatcaaagagggcggccacattttctataacatttggatgagagtcacacgagaacgagatgaacaccgaagtaattttttatgacagcatgatccaaaaaaatcgagagaacggtgttatccccgtctcatcctattttgatctcaaaccaaacacataattagtcaatgagcactgacttgatgtagaagaacttggtacatataccaggaaatgactctgacttgctgagatgccttgtagtccctcggtcccgtaaattatacagtagtatttaaacttcctcgcacaaaggaaaactatttgtttttgcatgccttgtaaattagctatcaagtttttttttaaaaaaaacgacctttgaaaaccagtaaggaggactcgttcggtattcagttttaaagttcaaggttaaaaatcgaactgacgtgcaaaacaccctgggggttaaaatcaaaacacacaaatttggaaaatgagcaggcatgacttatgttgtgtccgttgaagtgccgtggctccatggcacggtggaactttacattagtgcggtagtgtcactgtggcagtaaagcccacttattttccattagagagagggagattaaaaacgtggctttacacattctgaaactaattgtgagtttgtgactcttggcttgcctgcagtgtccgcctgcaccttctataagtacagtcgcgagcctcagctatacaaaccaactagcgcatagtatctcctgagctccattcatcatcccaagtcttcactggtcttagatcacggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgtagttagcttaatcacctagagctcgctatggatcaggatgtggatgtgttcgttcgatcgtttccacgtccaatctcgctgaataaattgtctcgagaaagtttggctttgccgagataaataatagtgataattcttactcctgctacaaactgttttccttgaagcaactatgagcatcttccatagattcgcgacacgatttaaattttaaaaataacatttttaaaaaaatgtgtcacggttacacaactttttttttaacactagttgcgccccgcgtccaagcttactccctgaaattgcattcaaactctcgattcatgtctgcccttctcaccttctgtgtgcctgtgtgggctcgacgtctagtcgtcttcgactcttcgcctacatcagtcacctcctcacacgacgtgtctgcgacacaggccgcggcatagagcacgggcatgtagttttgaacaagtgcatgttgctacctcgactatgatcatgcaaaatattttttttattatttatagaggtttaaaataagacatggaataataagcctggtggccttgaagctggaagtgtagcatggtggaagtgcgggtttgacaggccgacagcgcagagcatatcgaaaatacagctgaaaaaagatccgattatacttgaaaaaaaggataatcaccgaagcaatggaaagctccattcctgtttcccggtggaagaaaaatttctagcctccatccctgcgaacacataggagaactttttatcccttcaccgataaatttatgcccgcgagaaatctgcaaatacaataaatacaaattaattatattaaattaatataaattgaaaaacaagatttaaaattataatagatttctactttagagttcagttagctattttataattagttgtattgaaattttagtaaaattttaacatatcaataagctaaaagaagattatggaacaagtatacggggaattgggggtagaccggttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgcataatgaggatcgaggatggttttagagctagaaatagcaagttaaaataaggctagtccgttatcaacttgaaaaagtggcaccgagtcggtgctttttttttgcggccgcgaattccaccggtgttaacggcaaacgctaattagtcactaggcccaggaaacactaactaagccctagcttatcctagcgcaacctagttaggtcttggttaccggcctagaaggccgatctcccgggtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcccgggcacccagctttcttgtacaaagtggccgttaacggatcggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctagtatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcgggcataatgaggatcgaggatgaggggccgccggatagatggcgtctagcatatcgataggacatgacaagtggtacgatccccgtcacatgtccatggaggcatctgatatggacacggcgtgtatctatcgcggctggaacagaaccagcgctcgcgcggcggtcggcgggagggacagaccttggctccgtgcgttcaggttgtgcttgtgccgcgcgccacgcacggtctccgccgcctgcagctgaaattttagatttacatcctatccctttattttttttatttgtcacaattcagttcaaaaatgaagaacggaggtagtgcatcctttgtgagactaatgaaaatcacatctggatcctgaaatcggcgtcgtaacctacaaggccacggactggattagatagtggtccatggtgcataatgaggatcgaggggtaccggtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctagggaagttcctattccgaagttcctattctctagaaagtataggaacttcagatccaccgggatccaccatggttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggatccaccatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcaccggtgccatgaggagcaatcattgttcaagacatgatgcaaagctagaaaactttgattgtggccgtcctaattgtgaagtttaggccggggggaacttcatgaaccctatcgaagcttaattagttcttttttgttgttagccatgtttgtattgtagtttaggtgaacaacatgacgccgcacccgcgatctcagggctcgtccccacacaggagggcacgtcgtcgtcttcgccgccgagcatcagagattcagagcacgtacacgcacatctcaagcaaacggagtagtacgtcctactcctacgtacatacctagccgacgacctttatgtgcacaccaccactgctctgctgcccggcctctccgtcgtccgttcatcaccagctggtctggtccttcaatttccatgcgtcggtccgcccgcataatgaggatcgaggatgaggcccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 147 - DNA, 23705 bp, Artificial Sequence
  RC000021
gtttacccgccaatatatcctgtcaaacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgaattcgagctcggtacggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggataaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgaagcttgcatgcctgcatctagaactaccagcagcatgatcagagtgaggatagttgctacttcaatggcctaggtttgataactactgtcgatccatctgtcgacaattgtttgtttcctctcacaattcacgtttctgccgccacttctttgcacctaacattgcccgtgtcgctgttattagttttgtggttttgcattgtctgtatatagtctgatgaggctatagattgagccttcaaaagtgtttcgttgggcctcttgttgaatgtactccaaagtctcggtgcaccatcagacgtattcctagaatggcacaatctggctatcagaactggtaggtttagtccaaatgtaatgatgtgttctaaagtagtcgggctgagtcaaacagcagcttcttctcttgttcaaaattttgaacctggtaatgttgtcatttcatgatagatcatagatacattcttggtttcactatatcttagaaagtccagccaacagaagtactcaagtacaggtgaacctttcagtttagctggagacatgggcagcagtgtacaaagtctaatccacagctgtgaccctgtgagctgggggttgggcctgcctcggaggggatcgtgtcttttctgtttgtgcaattatcagtgcctaaagaacatgtgttataacagttatacacggtcaattattcaatccatcttttaacgtgtgtttggttgtacgtataagaagggatcaaagagggcggccacattttctataacatttggatgagagtcacacgagaacgagatgaacaccgaagtaattttttatgacagcatgatccaaaaaaatcgagagaacggtgttatccccgtctcatcctattttgatctcaaaccaaacacataattagtcaatgagcactgacttgatgtagaagaacttggtacatataccaggaaatgactctgacttgctgagatgccttgtagtccctcggtcccgtaaattatacagtagtatttaaacttcctcgcacaaaggaaaactatttgtttttgcatgccttgtaaattagctatcaagtttttttttaaaaaaaacgacctttgaaaaccagtaaggaggactcgttcggtattcagttttaaagttcaaggttaaaaatcgaactgacgtgcaaaacaccctgggggttaaaatcaaaacacacaaatttggaaaatgagcaggcatgacttatgttgtgtccgttgaagtgccgtggctccatggcacggtggaactttacattagtgcggtagtgtcactgtggcagtaaagcccacttattttccattagagagagggagattaaaaacgtggctttacacattctgaaactaattgtgagtttgtgactcttggcttgcctgcagtgtccgcctgcaccttctataagtacagtcgcgagcctcagctatacaaaccaactagcgcatagtatctcctgagctccattcatcatcccaagtcttcactggtcttagatcacggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgtagttagcttaatcacctagagctcgctatggatcaggatgtggatgtgttcgttcgatcgtttccacgtccaatctcgctgaataaattgtctcgagaaagtttggctttgccgagataaataatagtgataattcttactcctgctacaaactgttttccttgaagcaactatgagcatcttccatagattcgcgacacgatttaaattttaaaaataacatttttaaaaaaatgtgtcacggttacacaactttttttttaacactagttgcgccccgcgtccaagcttactccctgaaattgcattcaaactctcgattcatgtctgcccttctcaccttctgtgtgcctgtgtgggctcgacgtctagtcgtcttcgactcttcgcctacatcagtcacctcctcacacgacgtgtctgcgacacaggccgcggcatagagcacgggcatgtagttttgaacaagtgcatgttgctacctcgactatgatcatgcaaaatattttttttattatttatagaggtttaaaataagacatggaataataagcctggtggccttgaagctggaagtgtagcatggtggaagtgcgggtttgacaggccgacagcgcagagcatatcgaaaatacagctgaaaaaagatccgattatacttgaaaaaaaggataatcaccgaagcaatggaaagctccattcctgtttcccggtggaagaaaaatttctagcctccatccctgcgaacacataggagaactttttatcccttcaccgataaatttatgcccgcgagaaatctgcaaatacaataaatacaaattaattatattaaattaatataaattgaaaaacaagatttaaaattataatagatttctactttagagttcagttagctattttataattagttgtattgaaattttagtaaaattttaacatatcaataagctaaaagaagattatggaacaagtatacggggaattgggggtagaccggttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgcataatgaggatcgaggatggttttagagctagaaatagcaagttaaaataaggctagtccgttatcaacttgaaaaagtggcaccgagtcggtgctttttttttgcggccgcgaattccaccggtgttaacggcaaacgctaattagtcactaggcccaggaaacactaactaagccctagcttatcctagcgcaacctagttaggtcttggttaccggcctagaaggccgatctcccgggtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcccgggcacccagctttcttgtacaaagtggccgttaacggatcggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctagtatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcgggcataatgaggatcgaggatgaggggccgccggatagatggcgtctagcatatcgataggacatgacaagtggtacgatccccgtcacatgtccatggaggcatctgatatggacacggcgtgtatctatcgcggctggaacagaaccagcgctcgcgcggcggtcggcgggagggacagaccttggctccgtgcgttcaggttgtgcttgtgccgcgcgccacgcacggtctccgccgcctgcagctgaaattttagatttacatcctatccctttattttttttatttgtcacaattcagttcaaaaatgaagaacggaggtagtgcatcctttgtgagactaatgaaaatcacatctggatcctgaaatcggcgtcgtaacctacaaggccacggactggattagatagtggtccatggtgcataatgaggatcgaggggtaccggtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctagggaagttcctattccgaagttcctattctctagaaagtataggaacttcagatccaccgggatccaccatggttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggatccaccatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcaccggtgccatgaggagcaatcattgttcaagacatgatgcaaagctagaaaactttgattgtggccgtcctaattgtgaagtttaggccggggggaacttcatgaaccctatcgaagcttaattagttcttttttgttgttagccatgtttgtattgtagtttaggtgaacaacatgacgccgcacccgcgatctcagggctcgtccccacacaggagggcacgtcgtcgtcttcgccgccgagcatcagagattcagagcacgtacacgcacatctcaagcaaacggagtagtacgtcctactcctacgtacatacctagccgacgacctttatgtgcacaccaccactgctctgctgcccggcctctccgtcgtccgttcatcaccagctggtctggtccttcaatttccatgcgtcggtccgcccgcataatgaggatcgaggatgaggcccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 148 - DNA, 23690 bp, Artificial Sequence
  RC000022
gtttacccgccaatatatcctgtcaaacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgaattcgagctcggtacggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatgatcgggctgtccatgattaagaactggctgcggagccaaccggcgcccggtggaggcggcagcggtggcggaggctccggaggcggtggcgacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggataaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgaagcttgcatgcctgcatctagaactaccagcagcatgatcagagtgaggatagttgctacttcaatggcctaggtttgataactactgtcgatccatctgtcgacaattgtttgtttcctctcacaattcacgtttctgccgccacttctttgcacctaacattgcccgtgtcgctgttattagttttgtggttttgcattgtctgtatatagtctgatgaggctatagattgagccttcaaaagtgtttcgttgggcctcttgttgaatgtactccaaagtctcggtgcaccatcagacgtattcctagaatggcacaatctggctatcagaactggtaggtttagtccaaatgtaatgatgtgttctaaagtagtcgggctgagtcaaacagcagcttcttctcttgttcaaaattttgaacctggtaatgttgtcatttcatgatagatcatagatacattcttggtttcactatatcttagaaagtccagccaacagaagtactcaagtacaggtgaacctttcagtttagctggagacatgggcagcagtgtacaaagtctaatccacagctgtgaccctgtgagctgggggttgggcctgcctcggaggggatcgtgtcttttctgtttgtgcaattatcagtgcctaaagaacatgtgttataacagttatacacggtcaattattcaatccatcttttaacgtgtgtttggttgtacgtataagaagggatcaaagagggcggccacattttctataacatttggatgagagtcacacgagaacgagatgaacaccgaagtaattttttatgacagcatgatccaaaaaaatcgagagaacggtgttatccccgtctcatcctattttgatctcaaaccaaacacataattagtcaatgagcactgacttgatgtagaagaacttggtacatataccaggaaatgactctgacttgctgagatgccttgtagtccctcggtcccgtaaattatacagtagtatttaaacttcctcgcacaaaggaaaactatttgtttttgcatgccttgtaaattagctatcaagtttttttttaaaaaaaacgacctttgaaaaccagtaaggaggactcgttcggtattcagttttaaagttcaaggttaaaaatcgaactgacgtgcaaaacaccctgggggttaaaatcaaaacacacaaatttggaaaatgagcaggcatgacttatgttgtgtccgttgaagtgccgtggctccatggcacggtggaactttacattagtgcggtagtgtcactgtggcagtaaagcccacttattttccattagagagagggagattaaaaacgtggctttacacattctgaaactaattgtgagtttgtgactcttggcttgcctgcagtgtccgcctgcaccttctataagtacagtcgcgagcctcagctatacaaaccaactagcgcatagtatctcctgagctccattcatcatcccaagtcttcactggtcttagatcacggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgtagttagcttaatcacctagagctcgctatggatcaggatgtggatgtgttcgttcgatcgtttccacgtccaatctcgctgaataaattgtctcgagaaagtttggctttgccgagataaataatagtgataattcttactcctgctacaaactgttttccttgaagcaactatgagcatcttccatagattcgcgacacgatttaaattttaaaaataacatttttaaaaaaatgtgtcacggttacacaactttttttttaacactagttgcgccccgcgtccaagcttactccctgaaattgcattcaaactctcgattcatgtctgcccttctcaccttctgtgtgcctgtgtgggctcgacgtctagtcgtcttcgactcttcgcctacatcagtcacctcctcacacgacgtgtctgcgacacaggccgcggcatagagcacgggcatgtagttttgaacaagtgcatgttgctacctcgactatgatcatgcaaaatattttttttattatttatagaggtttaaaataagacatggaataataagcctggtggccttgaagctggaagtgtagcatggtggaagtgcgggtttgacaggccgacagcgcagagcatatcgaaaatacagctgaaaaaagatccgattatacttgaaaaaaaggataatcaccgaagcaatggaaagctccattcctgtttcccggtggaagaaaaatttctagcctccatccctgcgaacacataggagaactttttatcccttcaccgataaatttatgcccgcgagaaatctgcaaatacaataaatacaaattaattatattaaattaatataaattgaaaaacaagatttaaaattataatagatttctactttagagttcagttagctattttataattagttgtattgaaattttagtaaaattttaacatatcaataagctaaaagaagattatggaacaagtatacggggaattgggggtagaccggttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgcataatgaggatcgaggatggttttagagctagaaatagcaagttaaaataaggctagtccgttatcaacttgaaaaagtggcaccgagtcggtgctttttttttgcggccgcgaattccaccggtgttaacggcaaacgctaattagtcactaggcccaggaaacactaactaagccctagcttatcctagcgcaacctagttaggtcttggttaccggcctagaaggccgatctcccgggtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcccgggcacccagctttcttgtacaaagtggccgttaacggatcggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctagtatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcgggcataatgaggatcgaggatgaggggccgccggatagatggcgtctagcatatcgataggacatgacaagtggtacgatccccgtcacatgtccatggaggcatctgatatggacacggcgtgtatctatcgcggctggaacagaaccagcgctcgcgcggcggtcggcgggagggacagaccttggctccgtgcgttcaggttgtgcttgtgccgcgcgccacgcacggtctccgccgcctgcagctgaaattttagatttacatcctatccctttattttttttatttgtcacaattcagttcaaaaatgaagaacggaggtagtgcatcctttgtgagactaatgaaaatcacatctggatcctgaaatcggcgtcgtaacctacaaggccacggactggattagatagtggtccatggtgcataatgaggatcgaggggtaccggtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctagggaagttcctattccgaagttcctattctctagaaagtataggaacttcagatccaccgggatccaccatggttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggatccaccatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcaccggtgccatgaggagcaatcattgttcaagacatgatgcaaagctagaaaactttgattgtggccgtcctaattgtgaagtttaggccggggggaacttcatgaaccctatcgaagcttaattagttcttttttgttgttagccatgtttgtattgtagtttaggtgaacaacatgacgccgcacccgcgatctcagggctcgtccccacacaggagggcacgtcgtcgtcttcgccgccgagcatcagagattcagagcacgtacacgcacatctcaagcaaacggagtagtacgtcctactcctacgtacatacctagccgacgacctttatgtgcacaccaccactgctctgctgcccggcctctccgtcgtccgttcatcaccagctggtctggtccttcaatttccatgcgtcggtccgcccgcataatgaggatcgaggatgaggcccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 149 - DNA, 23672 bp, Artificial Sequence
  RC000023
gtttacccgccaatatatcctgtcaaacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgaattcgagctcggtacggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatggcggagccgaagctggaggacttcctcggcggtggaggcggcagcggtggcggaggctccggaggcggtggcgacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggataaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgaagcttgcatgcctgcatctagaactaccagcagcatgatcagagtgaggatagttgctacttcaatggcctaggtttgataactactgtcgatccatctgtcgacaattgtttgtttcctctcacaattcacgtttctgccgccacttctttgcacctaacattgcccgtgtcgctgttattagttttgtggttttgcattgtctgtatatagtctgatgaggctatagattgagccttcaaaagtgtttcgttgggcctcttgttgaatgtactccaaagtctcggtgcaccatcagacgtattcctagaatggcacaatctggctatcagaactggtaggtttagtccaaatgtaatgatgtgttctaaagtagtcgggctgagtcaaacagcagcttcttctcttgttcaaaattttgaacctggtaatgttgtcatttcatgatagatcatagatacattcttggtttcactatatcttagaaagtccagccaacagaagtactcaagtacaggtgaacctttcagtttagctggagacatgggcagcagtgtacaaagtctaatccacagctgtgaccctgtgagctgggggttgggcctgcctcggaggggatcgtgtcttttctgtttgtgcaattatcagtgcctaaagaacatgtgttataacagttatacacggtcaattattcaatccatcttttaacgtgtgtttggttgtacgtataagaagggatcaaagagggcggccacattttctataacatttggatgagagtcacacgagaacgagatgaacaccgaagtaattttttatgacagcatgatccaaaaaaatcgagagaacggtgttatccccgtctcatcctattttgatctcaaaccaaacacataattagtcaatgagcactgacttgatgtagaagaacttggtacatataccaggaaatgactctgacttgctgagatgccttgtagtccctcggtcccgtaaattatacagtagtatttaaacttcctcgcacaaaggaaaactatttgtttttgcatgccttgtaaattagctatcaagtttttttttaaaaaaaacgacctttgaaaaccagtaaggaggactcgttcggtattcagttttaaagttcaaggttaaaaatcgaactgacgtgcaaaacaccctgggggttaaaatcaaaacacacaaatttggaaaatgagcaggcatgacttatgttgtgtccgttgaagtgccgtggctccatggcacggtggaactttacattagtgcggtagtgtcactgtggcagtaaagcccacttattttccattagagagagggagattaaaaacgtggctttacacattctgaaactaattgtgagtttgtgactcttggcttgcctgcagtgtccgcctgcaccttctataagtacagtcgcgagcctcagctatacaaaccaactagcgcatagtatctcctgagctccattcatcatcccaagtcttcactggtcttagatcacggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgtagttagcttaatcacctagagctcgctatggatcaggatgtggatgtgttcgttcgatcgtttccacgtccaatctcgctgaataaattgtctcgagaaagtttggctttgccgagataaataatagtgataattcttactcctgctacaaactgttttccttgaagcaactatgagcatcttccatagattcgcgacacgatttaaattttaaaaataacatttttaaaaaaatgtgtcacggttacacaactttttttttaacactagttgcgccccgcgtccaagcttactccctgaaattgcattcaaactctcgattcatgtctgcccttctcaccttctgtgtgcctgtgtgggctcgacgtctagtcgtcttcgactcttcgcctacatcagtcacctcctcacacgacgtgtctgcgacacaggccgcggcatagagcacgggcatgtagttttgaacaagtgcatgttgctacctcgactatgatcatgcaaaatattttttttattatttatagaggtttaaaataagacatggaataataagcctggtggccttgaagctggaagtgtagcatggtggaagtgcgggtttgacaggccgacagcgcagagcatatcgaaaatacagctgaaaaaagatccgattatacttgaaaaaaaggataatcaccgaagcaatggaaagctccattcctgtttcccggtggaagaaaaatttctagcctccatccctgcgaacacataggagaactttttatcccttcaccgataaatttatgcccgcgagaaatctgcaaatacaataaatacaaattaattatattaaattaatataaattgaaaaacaagatttaaaattataatagatttctactttagagttcagttagctattttataattagttgtattgaaattttagtaaaattttaacatatcaataagctaaaagaagattatggaacaagtatacggggaattgggggtagaccggttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgcataatgaggatcgaggatggttttagagctagaaatagcaagttaaaataaggctagtccgttatcaacttgaaaaagtggcaccgagtcggtgctttttttttgcggccgcgaattccaccggtgttaacggcaaacgctaattagtcactaggcccaggaaacactaactaagccctagcttatcctagcgcaacctagttaggtcttggttaccggcctagaaggccgatctcccgggtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcccgggcacccagctttcttgtacaaagtggccgttaacggatcggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctagtatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcgggcataatgaggatcgaggatgaggggccgccggatagatggcgtctagcatatcgataggacatgacaagtggtacgatccccgtcacatgtccatggaggcatctgatatggacacggcgtgtatctatcgcggctggaacagaaccagcgctcgcgcggcggtcggcgggagggacagaccttggctccgtgcgttcaggttgtgcttgtgccgcgcgccacgcacggtctccgccgcctgcagctgaaattttagatttacatcctatccctttattttttttatttgtcacaattcagttcaaaaatgaagaacggaggtagtgcatcctttgtgagactaatgaaaatcacatctggatcctgaaatcggcgtcgtaacctacaaggccacggactggattagatagtggtccatggtgcataatgaggatcgaggggtaccggtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctagggaagttcctattccgaagttcctattctctagaaagtataggaacttcagatccaccgggatccaccatggttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggatccaccatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcaccggtgccatgaggagcaatcattgttcaagacatgatgcaaagctagaaaactttgattgtggccgtcctaattgtgaagtttaggccggggggaacttcatgaaccctatcgaagcttaattagttcttttttgttgttagccatgtttgtattgtagtttaggtgaacaacatgacgccgcacccgcgatctcagggctcgtccccacacaggagggcacgtcgtcgtcttcgccgccgagcatcagagattcagagcacgtacacgcacatctcaagcaaacggagtagtacgtcctactcctacgtacatacctagccgacgacctttatgtgcacaccaccactgctctgctgcccggcctctccgtcgtccgttcatcaccagctggtctggtccttcaatttccatgcgtcggtccgcccgcataatgaggatcgaggatgaggcccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 150 - DNA, 23762 bp, Artificial Sequence
  RC000024
gtttacccgccaatatatcctgtcaaacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgaattcgagctcggtacggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatggcggagccgaagctggaggacttcctcggcggtggaggcggcagcggtggcggaggctccggaggcggtggcatcgggctgtccatgattaagaactggctgcggagccaaccggcgcccggtggaggcggcagcggtggcggaggctccggaggcggtggcgacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggataaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgaagcttgcatgcctgcatctagaactaccagcagcatgatcagagtgaggatagttgctacttcaatggcctaggtttgataactactgtcgatccatctgtcgacaattgtttgtttcctctcacaattcacgtttctgccgccacttctttgcacctaacattgcccgtgtcgctgttattagttttgtggttttgcattgtctgtatatagtctgatgaggctatagattgagccttcaaaagtgtttcgttgggcctcttgttgaatgtactccaaagtctcggtgcaccatcagacgtattcctagaatggcacaatctggctatcagaactggtaggtttagtccaaatgtaatgatgtgttctaaagtagtcgggctgagtcaaacagcagcttcttctcttgttcaaaattttgaacctggtaatgttgtcatttcatgatagatcatagatacattcttggtttcactatatcttagaaagtccagccaacagaagtactcaagtacaggtgaacctttcagtttagctggagacatgggcagcagtgtacaaagtctaatccacagctgtgaccctgtgagctgggggttgggcctgcctcggaggggatcgtgtcttttctgtttgtgcaattatcagtgcctaaagaacatgtgttataacagttatacacggtcaattattcaatccatcttttaacgtgtgtttggttgtacgtataagaagggatcaaagagggcggccacattttctataacatttggatgagagtcacacgagaacgagatgaacaccgaagtaattttttatgacagcatgatccaaaaaaatcgagagaacggtgttatccccgtctcatcctattttgatctcaaaccaaacacataattagtcaatgagcactgacttgatgtagaagaacttggtacatataccaggaaatgactctgacttgctgagatgccttgtagtccctcggtcccgtaaattatacagtagtatttaaacttcctcgcacaaaggaaaactatttgtttttgcatgccttgtaaattagctatcaagtttttttttaaaaaaaacgacctttgaaaaccagtaaggaggactcgttcggtattcagttttaaagttcaaggttaaaaatcgaactgacgtgcaaaacaccctgggggttaaaatcaaaacacacaaatttggaaaatgagcaggcatgacttatgttgtgtccgttgaagtgccgtggctccatggcacggtggaactttacattagtgcggtagtgtcactgtggcagtaaagcccacttattttccattagagagagggagattaaaaacgtggctttacacattctgaaactaattgtgagtttgtgactcttggcttgcctgcagtgtccgcctgcaccttctataagtacagtcgcgagcctcagctatacaaaccaactagcgcatagtatctcctgagctccattcatcatcccaagtcttcactggtcttagatcacggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgtagttagcttaatcacctagagctcgctatggatcaggatgtggatgtgttcgttcgatcgtttccacgtccaatctcgctgaataaattgtctcgagaaagtttggctttgccgagataaataatagtgataattcttactcctgctacaaactgttttccttgaagcaactatgagcatcttccatagattcgcgacacgatttaaattttaaaaataacatttttaaaaaaatgtgtcacggttacacaactttttttttaacactagttgcgccccgcgtccaagcttactccctgaaattgcattcaaactctcgattcatgtctgcccttctcaccttctgtgtgcctgtgtgggctcgacgtctagtcgtcttcgactcttcgcctacatcagtcacctcctcacacgacgtgtctgcgacacaggccgcggcatagagcacgggcatgtagttttgaacaagtgcatgttgctacctcgactatgatcatgcaaaatattttttttattatttatagaggtttaaaataagacatggaataataagcctggtggccttgaagctggaagtgtagcatggtggaagtgcgggtttgacaggccgacagcgcagagcatatcgaaaatacagctgaaaaaagatccgattatacttgaaaaaaaggataatcaccgaagcaatggaaagctccattcctgtttcccggtggaagaaaaatttctagcctccatccctgcgaacacataggagaactttttatcccttcaccgataaatttatgcccgcgagaaatctgcaaatacaataaatacaaattaattatattaaattaatataaattgaaaaacaagatttaaaattataatagatttctactttagagttcagttagctattttataattagttgtattgaaattttagtaaaattttaacatatcaataagctaaaagaagattatggaacaagtatacggggaattgggggtagaccggttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgcataatgaggatcgaggatggttttagagctagaaatagcaagttaaaataaggctagtccgttatcaacttgaaaaagtggcaccgagtcggtgctttttttttgcggccgcgaattccaccggtgttaacggcaaacgctaattagtcactaggcccaggaaacactaactaagccctagcttatcctagcgcaacctagttaggtcttggttaccggcctagaaggccgatctcccgggtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcccgggcacccagctttcttgtacaaagtggccgttaacggatcggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctagtatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcgggcataatgaggatcgaggatgaggggccgccggatagatggcgtctagcatatcgataggacatgacaagtggtacgatccccgtcacatgtccatggaggcatctgatatggacacggcgtgtatctatcgcggctggaacagaaccagcgctcgcgcggcggtcggcgggagggacagaccttggctccgtgcgttcaggttgtgcttgtgccgcgcgccacgcacggtctccgccgcctgcagctgaaattttagatttacatcctatccctttattttttttatttgtcacaattcagttcaaaaatgaagaacggaggtagtgcatcctttgtgagactaatgaaaatcacatctggatcctgaaatcggcgtcgtaacctacaaggccacggactggattagatagtggtccatggtgcataatgaggatcgaggggtaccggtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctagggaagttcctattccgaagttcctattctctagaaagtataggaacttcagatccaccgggatccaccatggttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggatccaccatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcaccggtgccatgaggagcaatcattgttcaagacatgatgcaaagctagaaaactttgattgtggccgtcctaattgtgaagtttaggccggggggaacttcatgaaccctatcgaagcttaattagttcttttttgttgttagccatgtttgtattgtagtttaggtgaacaacatgacgccgcacccgcgatctcagggctcgtccccacacaggagggcacgtcgtcgtcttcgccgccgagcatcagagattcagagcacgtacacgcacatctcaagcaaacggagtagtacgtcctactcctacgtacatacctagccgacgacctttatgtgcacaccaccactgctctgctgcccggcctctccgtcgtccgttcatcaccagctggtctggtccttcaatttccatgcgtcggtccgcccgcataatgaggatcgaggatgaggcccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 151 - DNA, 8924 bp, Artificial Sequence
  RV020636
gtttacccgccaatatatcctgtcaaacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgagctcggtacggccagaatggcccggaccgggttaccaagcggccgcatcgagcagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaactcgagcaacgagatcatgagccaatcaaagaggagtgatgtagacctaaagcaataatggagccatgacgtaagggcttacgcccatacgaaataattaaaggctgatgtgacctgtcggtctctcagaacctttactttttatgtttggcgtgtatttttaaatttccacggcaatgacgatgtgaccgtcgacccactaaaacattgctttgtcaaaagctaaaaaagatgatgcccgacagccacttgtgtgaagcatgagaagccggtccctccactaagaaaattagtgaagcatcttccagtggtccctccactcacagctcaatcagtgagcaacaggacgaaggaaatgacgtaagccatgacgtctaatcccagggcccggtgaccaatcgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaaacaacgtaagcgcttacgcaccgaacaacgtaagcgcttacgcaccgaacaacgtaagcgcttacgcacccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactgatgtctctggaatggaaggaggaggaagtgagaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtcacccggtccgggcctagaaggccagcttcaagtttgtacaaaaaagcaggctccggccagaatggcccggaccgggttaccgaattcgagctcggtaccctgggatccgatatcgatgggccctggccgaagcttggtcacccggtccgggcctagaaggccgatctcccgggcacccagctttcttgtacaaagtggccgttaacggatcggccagaatggcccggaccgaagccgaggccggccacactgatagtttaaactgaaggcgggaaacgacaatctgatcatgagcggagaattaagggagtcacgttatgacccccgccgatgacgcgggacaagccgttttacgtttggaactgacagaaccgcaacgattgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcccggcggatctcgactctagaggatcgctcaggaaggccgctgagatagagccatggggaggagggcgtgttgcgcgaaggaaggcgttaagagaggggcgtggacgagcaaggaggacgatgccttggccgcctacgtcaaggcccacggcgaaggcaaatggagggaagtgccccagaaagccggtttgcgtcggtgcggcaagagctgccggctgcggtggctgaactacctccggcccaacatcaggcgcggcaacatctcctacgacgaggaggatctcatcatccgcctccacaggctcctcggcaacaggtggtcgctgattgcaggcaggctgcctggccgaacagacaatgaaatcaagaactactggaacagcacgctgggccggagggcaggcgccggcgccggcgccggcggcagatccacgatggcgctttcagcttcccgagttcagcaggcggaagaactgctgcaacgacctgctgagaggcagctgatgaggagccagcttgctgcagccgccaggagcatcaactggagctacgccctcttctggtccatttcagacactcaaccaggggtgctgacgtggacggacgggttctacaacggcgaggtgaagacgcggaagatttccaactccgtggagctgacatccgaccagctcgtcatgcagaggagcgaccagctccgggagctctacgaggccctcctgtcgggcgagggcgaccgccgcgctgcgcctgcgcggccggccggctctctgtcgccggaggacctcggcgacaccgagtggtactacgtggtgtccatgacctacgccttccggccaggccaagggttgcccggcaggagtttcgcgagcgacgagcatgtctggctgtgcaacgcgcacctcgccggcagcaaagccttcccccgcgcgctcctcgccaagagcgcgtccattcagtcaatcctctgcatcccggttatgggcggcgtgcttgagcttggtacaactgacacggtgccggaggccccggacttggtcagccgagcaaccgcggctttctgggagccgcagtgcccgagctccagcccgtcaggacgagcaaacgagacgggcgaggccgcagcagacgacggcacgtttgcgttcgaggaactcgaccacaataatggcatggacgacatagaggcgatgaccgccgccgggggacacgggcaggaggaggagctaagactaagagaagccgaggccctgtcagacgacgcaagcctggagcacatcaccaaggagatcgaggagttctacagcctctgcgacgaaatggacctgcaggcgctaccactaccgctagaggacggctggaccgtggacgcgtccaatttcgaggtcccctgctcttccccgcagccagcgccgcctccggtggatagggctaccgctaacgtcgccgccgacgcctcaagggcacccgtctacggctctcgcgcgacgagtttcatggcttggacgaggtcctcgcagcagtcgtcgtgctccgacgacgcggcgcccgcagcagtagtgccggccatcgaggagccgcagagattgctgaagaaagtggtggccggcggcggtgcttgggagagctgtggcggcgcgacgggagcagcacaggaaatgagtggcactggcaccaagaaccacgtcatgtcggagcgaaagcgacgagagaagctcaacgagatgttcctcgtcctcaagtcactgcttccgtccattcacagggtgaacaaagcgtcgatcctcgccgaaacgatagcctacctcaaggagcttcagagaagggtgcaagagctggagtccagtagggaacctgcgtcgcgcccatccgaaacgacgacaaggctaataacaaggccctcccgtggcaataatgagagtgtgaggaaggaggtctgcgcgggctccaagaggaagagcccagagctcggcagagacgacgtggagcgccccccggtcctcacgatggacgccggcaccagcaacgtcaccgtcaccgtctcggacaaggatgtgctcctggaggtgcagtgccggtgggaggagctcctgatgacgcgagtgttcgacgccatcaagagcctccatttggacgtcctctcggttcaggcttcagcgccagatggcttcatggggcttaagatacgagctcagtttgctggctccggtgccgtcgtgccctggatgatcagcgaggctcttcgcaaagctatagggaacccctgggtcgtcgtcgcgccggacaccggctcgcacgccaccccggccgcgacgtcgggcgcctgcgagacgggccagaatagcgccgctcatcgcgcggaccccgactcagccgggacgacgacgacctcggcggcggcggtgtgggcgcccaaggccgtgcggtgcacgggcggactcttcttcttccaccgggacacgacgccggcgcacgcgggcgagacggcgacgccaatggccggtggaggtggaggaggaggaggagaagcagggtcgtcggacgactgcagctcggcggcgtcggtatcgcttcgcgtcggaagccacgacgagccgtgcttctccggcgacggtgacggcgactggatggacgacgtgagggccctggcgtcgtttctggagtccgacgaggactggctccgctgtcagacggccgggcagcttgcgtagtggccaggtaccactaactatctatactgtaataatgttgtatagccgccggatagctagctagtttagtcattcagcggcgatgggtaataataaagtgtcatccatccatcaccatgcgtggcaacgtgagcaatgacctgattgaacaaattgaaatgaaaagaagaaatatgttatatgtcaacgagatttcctcataatgccactgacgacgtgtgtccaagaaatgtatcagtgatacgtatattcacaatttttttatgacttatactcacaatttgtttttttactacttatactcacaatttgttgtgcgtaccataacaatttcgatcgaatatatatcagaaagttgacgaaagtaagctcactcaaaaagttaaatgggctgcggaagctgcgtcaggcccaagttttggctattctatccggtatccacgattttgatggctgagggacatatgttcgcttaagcttggcgcgccggtcacccggtccgggcctagaaggccagcttcggccgccccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 152 - DNA, 24116 bp, Artificial Sequence
  Dz470control
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatctgcggttaccgaattcgagctcggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtaagtttctgcttctacctttgatatatatataataattatcattaattagtagtaatataatatttcaaatatttttttcaaaataaaagaatgtagtatatagcaattgcttttctgtagtttataacttcgtatagcatacattatacgaagttatacttttctaatatatgaccaaaatttgttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccgggatctgagtcgaaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagatcgatgggccctggccgaagcttggtcacccggtccgggcctagaaggccagcttcaagtttgtaccctggagcttgccgagtgccatccttggacactcgataaagtatattttattttttttattttgccaaccaaactttttgtggtatgttcctacactatgtagatctacatgtaccattttggcacaattacatatttacaaaaatgttttctataaatattagatttagttcgtttatttgaatttcttcggaaaattcacatttaaactgcaagtcactcgaaacatggaaaaccgtgcatgcaaaataaatgatatgcatgttatctagcacaagttacgaccgatttcagaagcagaccagaatcttcaagcaccatgctcactaaacatgaccgtgaacttgttatctagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtactcgacaaagaagccgttgtcgatgtactgttcgtcgagatctctttgtcgagtgtcacactaggcaaagtctttacggagtgtttttcaggctttgacactcggcaaagcgctcgattccagtagtgacagtaatttgcatcaaaaatagctgagagatttaggccccgtttcaatctcacgggataaagtttagcttcctgctaaactttagctatatgaattgaagtgctaaagtttagtttcaattaccaccattagctctcctgtttagattacaaatggctaaaagtagctaaaaaatagctgctaaagtttatctcgcgagattgaaacagggccttaaaatgagtcaactaatagaccaactaattattagctattagtcgttagcttctttaatctaagctaaaaccaactaatagcttatttgttgaattacaattagctcaacggaattctctgtttttctaaaaaaaaactgcccctctcttacagcaaattgtccgctgcccgtcgtccagatacaatgaacgtacctagtaggaactcttttacacgctcggtcgctcgccgcggatcggagtccccggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaaggatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgagctagacccagctttcttgtacaaagtggccgttaacggatccagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcaagctgttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccatttcaaatatttttttcaaaataaaagaatgtagtatatagcaattgcttttctgtagtttataacttcgtatagcatacattatacgaagttatacttttctaatatatgaccaaaatttgttgatgtgcaggtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgatgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacataaagctttccactggttgccatatatgatttgggcatttcactttgatcttaatgggccttgtaaagcccaagactcatgattatctttagttgatgctcttaattaggtgtgggcaaataattcaaactgtatgtacccgaccaaaaccaaagcaaaaataatcgaaccaaaccgaaaatttaaaaataaccgaatgaaaactaaatcctataactgaaagaactgaaaccgaatcaaaatatttaatgtaaccaaaaatatccgaaatataattatattgtcaaaaatattaataatttctagattaaataattaaaaatacttaaaaatttatataaaatagtaaaaatactcgaaaataaccacaaatattcaaaaacaaccgaaatatcccaaaatattcaaagcaaaataaccgaatggataccaaattttaaaaccgaaaaaactggaacaaaaccaaaatcgaaccaaaatttcaaaaatcgaataaatactaaactttagaacaaaaaaaaacgataaccgaatgtatacgaaccaaagccgaattagataaccgaacgtccaggactactcttaatctttccgccacttatgatttgggctattactttgtttataatgagccttttcaagctcaagttcatgattgtccgtgagatgagaaactgacttgttggattcgaaaccctagctagtattggttaatacttaatacataaatgacctgcattgacatcatcatccaagaaaataaaaattgtatgcttgagatatttagttttcctagctaggttttctttattttagtaccgaatctttaggtgtgccacgttaatttagacccattttttcatacttaccaactgagtctagtttaatcatgactataatcgtataaaatgattcagtcgacgtcattgcgaacgtatataaaatcatccaaattgacgtcattccaaagaggtaagcatgcttatctaagagtccgagcatactaaacaagacgacattttatttgcactccaaatcaaattttgtattgcctaaagaaaaacaatcaaactcaagtttcttaaaattaatttcattcaaactaatcactttcaatatctcacatattattcatgccatttctatttgtctaaacatgatttaaaaaaaaaagtaaaatacaaagattactatgcaaaaactctataaaaaaaaattcaaatttcttatttatttgtgacatcaaattttcaaaataatttttttaattatcggttgatccggtcagtcgataaaaacataaactttcagcgaccgttaaaactttcctactaccgatttagagaaaatcttagcttgaaacgtaattgtaacctgccttcatgcaagtcgcaagatatgtcatcctaagttgtatatgttttctcaaaagatgtatttacttgagaaaatacgtttcaacgttgatggacaaccaattaagaatcaagcacctttcgtaatcaatttaggcttatcgtctaaggtatactgatttacgacagttgactagacttataaggaacaaaataatagaatagtttctaaacacttcacctaatcatagagactaagatggtaattcgtaaacgacaaagcctagtgacactgtccattgtaaaattccacatcatattagtattaaacatatacatgtagtttcctgaacacatgtagtatcaaacacacttcgtggcttcttcctcgaaacctgcggccgctcattaattaagtcatctagttgaaggatcgctatcaactttgtatagaaaagttgggccgaattcgagctcggtacggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctagggggcgatcgctcgaggcgtacctagtggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgggttaccgaattcgagctcggtaccctgggatccgatatcgatgggccctggccgaagcttggtcacccggtccgggcctagaaggccgatctcccgggcacccagctttcttgtacaaagtggccgttaacggatcggccagaatggcccggaccgggttaccgaattcgagctcggtaccctgggatccgatatcgatgggccctggccgaagcttggtcacccggtccgggcctagaaggccagcttcggccgccccgggcaactttattatacaaagttgatagatcctcatgtcttcatcgtaagcttaaacaggccagaatggcctctggattcagcggcctagaaggccgaagtacttggtcttcctagtcgagtagatcacattcaagcttggtcacccggtccgtcaatattctgattccgatgacttcgtaggttcctagctcaagccgctcgtgtccaagcgtcacttacgattagctaatgattacggcatctaggaccgactagtggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 153 - DNA, 25210 bp, Artificial Sequence
  Dz470experimental
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatctgcggttaccgaattcgagctcggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtaagtttctgcttctacctttgatatatatataataattatcattaattagtagtaatataatatttcaaatatttttttcaaaataaaagaatgtagtatatagcaattgcttttctgtagtttataacttcgtatagcatacattatacgaagttatacttttctaatatatgaccaaaatttgttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccgggatctgagtcgaaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagatcgatgggccctggccgaagcttggtcacccggtccgggcctagaaggccagcttcaagtttgtaccctggagcttgccgagtgccatccttggacactcgataaagtatattttattttttttattttgccaaccaaactttttgtggtatgttcctacactatgtagatctacatgtaccattttggcacaattacatatttacaaaaatgttttctataaatattagatttagttcgtttatttgaatttcttcggaaaattcacatttaaactgcaagtcactcgaaacatggaaaaccgtgcatgcaaaataaatgatatgcatgttatctagcacaagttacgaccgatttcagaagcagaccagaatcttcaagcaccatgctcactaaacatgaccgtgaacttgttatctagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtactcgacaaagaagccgttgtcgatgtactgttcgtcgagatctctttgtcgagtgtcacactaggcaaagtctttacggagtgtttttcaggctttgacactcggcaaagcgctcgattccagtagtgacagtaatttgcatcaaaaatagctgagagatttaggccccgtttcaatctcacgggataaagtttagcttcctgctaaactttagctatatgaattgaagtgctaaagtttagtttcaattaccaccattagctctcctgtttagattacaaatggctaaaagtagctaaaaaatagctgctaaagtttatctcgcgagattgaaacagggccttaaaatgagtcaactaatagaccaactaattattagctattagtcgttagcttctttaatctaagctaaaaccaactaatagcttatttgttgaattacaattagctcaacggaattctctgtttttctaaaaaaaaactgcccctctcttacagcaaattgtccgctgcccgtcgtccagatacaatgaacgtacctagtaggaactcttttacacgctcggtcgctcgccgcggatcggagtccccggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaaggatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgagctagacccagctttcttgtacaaagtggccgttaacggatccagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcaagctgttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccatttcaaatatttttttcaaaataaaagaatgtagtatatagcaattgcttttctgtagtttataacttcgtatagcatacattatacgaagttatacttttctaatatatgaccaaaatttgttgatgtgcaggtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgatgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacataaagctttccactggttgccatatatgatttgggcatttcactttgatcttaatgggccttgtaaagcccaagactcatgattatctttagttgatgctcttaattaggtgtgggcaaataattcaaactgtatgtacccgaccaaaaccaaagcaaaaataatcgaaccaaaccgaaaatttaaaaataaccgaatgaaaactaaatcctataactgaaagaactgaaaccgaatcaaaatatttaatgtaaccaaaaatatccgaaatataattatattgtcaaaaatattaataatttctagattaaataattaaaaatacttaaaaatttatataaaatagtaaaaatactcgaaaataaccacaaatattcaaaaacaaccgaaatatcccaaaatattcaaagcaaaataaccgaatggataccaaattttaaaaccgaaaaaactggaacaaaaccaaaatcgaaccaaaatttcaaaaatcgaataaatactaaactttagaacaaaaaaaaacgataaccgaatgtatacgaaccaaagccgaattagataaccgaacgtccaggactactcttaatctttccgccacttatgatttgggctattactttgtttataatgagccttttcaagctcaagttcatgattgtccgtgagatgagaaactgacttgttggattcgaaaccctagctagtattggttaatacttaatacataaatgacctgcattgacatcatcatccaagaaaataaaaattgtatgcttgagatatttagttttcctagctaggttttctttattttagtaccgaatctttaggtgtgccacgttaatttagacccattttttcatacttaccaactgagtctagtttaatcatgactataatcgtataaaatgattcagtcgacgtcattgcgaacgtatataaaatcatccaaattgacgtcattccaaagaggtaagcatgcttatctaagagtccgagcatactaaacaagacgacattttatttgcactccaaatcaaattttgtattgcctaaagaaaaacaatcaaactcaagtttcttaaaattaatttcattcaaactaatcactttcaatatctcacatattattcatgccatttctatttgtctaaacatgatttaaaaaaaaaagtaaaatacaaagattactatgcaaaaactctataaaaaaaaattcaaatttcttatttatttgtgacatcaaattttcaaaataatttttttaattatcggttgatccggtcagtcgataaaaacataaactttcagcgaccgttaaaactttcctactaccgatttagagaaaatcttagcttgaaacgtaattgtaacctgccttcatgcaagtcgcaagatatgtcatcctaagttgtatatgttttctcaaaagatgtatttacttgagaaaatacgtttcaacgttgatggacaaccaattaagaatcaagcacctttcgtaatcaatttaggcttatcgtctaaggtatactgatttacgacagttgactagacttataaggaacaaaataatagaatagtttctaaacacttcacctaatcatagagactaagatggtaattcgtaaacgacaaagcctagtgacactgtccattgtaaaattccacatcatattagtattaaacatatacatgtagtttcctgaacacatgtagtatcaaacacacttcgtggcttcttcctcgaaacctgcggccgctcattaattaagtcatctagttgaaggatcgctatcaactttgtatagaaaagttgggccgaattcgagctcggtacggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggcgcgccatttaaatatggcgcccagcagctacgaggtggcggcttccatcctcctctgcgccgaggacagcagcagcatcctggacctcgaagcggaggccgaggaggaagcgctactggcgcggagcggggagcccggcggcggcgcggagttccccgtgccgtccgaggaatgcgtcgccggtttcctggagtctgaggcagcgcacatgccgcgggaggactacgccgagaggctgcgcagcggggggatggatctccgcgtccggacggacgccatcgactggatttggaaggttcacacgtgctacggtttcggccctctcactgcctgcttggccgtcaactacctggaccgcttcctctcgctctaccagcttccggaaggcaaggcttggatgacacagctgctgtccgtggcgtgcttgtccctggccgccaagatggaggagacctacgtcccttcgtccctggacctgcaggccggggacgcgcggtacgtgttcgaggcgaagacgatccagaggatggagctcctggtcctcagcacgctcaagtggaggatgcaagcggtcacccccttgtcgtacgtcgactacttcctccaccggctccgaggcggcgccgcgccgagcagacgcgccgtcctccgatccgcggagctcatcctgtgcatcgccagagggacgcactgcttggatttcaggccctcggagatcgccttggccgtcgccgccaccgtggccggcgaagagcgcgccgtggacatcgacagggccttcacccaccgtgtacataaggagagggtgtcgcgatgcctcgaagcgatccagcaggccaccgccaccatggccctgccgcagccgctgaaaagtgaaggcccgagcagcagcggccgcagggcctcgtcttcctcggccaccgtgccgcggagccccaccggggtgctggacgctggctgcctgagctacaggagagccgccgccgccgccgcctcgcacgcgagctccagctggcgcgacgaggacgacgacgactgccccccggctgtctgcagcaagaggaggaagattagcagatgaatttaaatgcccgggcgatcgctcgaggcgtacctagtggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgggttaccgaattcgagctcggtaccctgggatccgatatcgatgggccctggccgaagcttggtcacccggtccgggcctagaaggccgatctcccgggcacccagctttcttgtacaaagtggccgttaacggatcggccagaatggcccggaccgggttaccgaattcgagctcggtaccctgggatccgatatcgatgggccctggccgaagcttggtcacccggtccgggcctagaaggccagcttcggccgccccgggcaactttattatacaaagttgatagatcctcatgtcttcatcgtaagcttaaacaggccagaatggcctctggattcagcggcctagaaggccgaagtacttggtcttcctagtcgagtagatcacattcaagcttggtcacccggtccgtcaatattctgattccgatgacttcgtaggttcctagctcaagccgctcgtgtccaagcgtcacttacgattagctaatgattacggcatctaggaccgactagtggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 154 - DNA, 15485 bp, Artificial Sequence
  RV03440X
gtttacccgccaatatatcctgtcaaacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgaattcgagctcggtacggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcctcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcggccatggcggcgcgcagctcttcagtgtctggaacgacacttaaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgaagcttgcatgcctgcatctagagaattccaccggtgttaacggcaaacgctaattagtcactaggcccaggaaacactaactaagccctagcttatcctagcgcaacctagttaggtcttggttaccggcctagaaggccgatctcccgggcacccagctttcttgtacaaagtggccgttaacggatcggccagaatggcccggaccgaagctttgtacagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcaagcttactaccagcagcatgatcagagtgaggatagttgctacttcaatggcctaggtttgataactactgtcgatccatctgtcgacaattgtttgtttcctctcacaattcacgtttctgccgccacttctttgcacctaacattgcccgtgtcgctgttattagttttgtggttttgcattgtctgtatatagtctgatgaggctatagattgagccttcaaaagtgtttcgttgggcctcttgttgaatgtactccaaagtctcggtgcaccatcagacgtattcctagaatggcacaatctggctatcagaactggtaggtttagtccaaatgtaatgatgtgttctaaagtagtcgggctgagtcaaacagcagcttcttctcttgttcaaaattttgaacctggtaatgttgtcatttcatgatagatcatagatacattcttggtttcactatatcttagaaagtccagccaacagaagtactcaagtacaggtgaacctttcagtttagctggagacatgggcagcagtgtacaaagtctaatccacagctgtgaccctgtgagctgggggttgggcctgcctcggaggggatcgtgtcttttctgtttgtgcaattatcagtgcctaaagaacatgtgttataacagttatacacggtcaattattcaatccatcttttaacgtgtgtttggttgtacgtataagaagggatcaaagagggcggccacattttctataacatttggatgagagtcacacgagaacgagatgaacaccgaagtaattttttatgacagcatgatccaaaaaaatcgagagaacggtgttatccccgtctcatcctattttgatctcaaaccaaacacataattagtcaatgagcactgacttgatgtagaagaacttggtacatataccaggaaatgactctgacttgctgagatgccttgtagtccctcggtcccgtaaattatacagtagtatttaaacttcctcgcacaaaggaaaactatttgtttttgcatgccttgtaaattagctatcaagtttttttttaaaaaaaacgacctttgaaaaccagtaaggaggactcgttcggtattcagttttaaagttcaaggttaaaaatcgaactgacgtgcaaaacaccctgggggttaaaatcaaaacacacaaatttggaaaatgagcaggcatgacttatgttgtgtccgttgaagtgccgtggctccatggcacggtggaactttacattagtgcggtagtgtcactgtggcagtaaagcccacttattttccattagagagagggagattaaaaacgtggctttacacattctgaaactaattgtgagtttgtgactcttggcttgcctgcagtgtccgcctgcaccttctataagtacagtcgcgagcctcagctatacaaaccaactagcgcatagtatctcctgagctccattcatcatcccaagtcttcactggtcttagatcaccctagtatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 155 - DNA, 14900 bp, Artificial Sequence
  RZ000001
gtttacccgccaatatatcctgtcaaacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgaattcgagctcggtacggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatgatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggataaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgaagcttgcatgcctgcatctagagaattccaccggtgttaacggcaaacgctaattagtcactaggcccaggaaacactaactaagccctagcttatcctagcgcaacctagttaggtcttggttaccggcctagaaggccgatctcccgggcacccagctttcttgtacaaagtggccgttaacggatcggccagaatggcccggaccgaagctttgtacagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcaagcttactaccagcagcatgatcagagtgaggatagttgctacttcaatggcctaggtttgataactactgtcgatccatctgtcgacaattgtttgtttcctctcacaattcacgtttctgccgccacttctttgcacctaacattgcccgtgtcgctgttattagttttgtggttttgcattgtctgtatatagtctgatgaggctatagattgagccttcaaaagtgtttcgttgggcctcttgttgaatgtactccaaagtctcggtgcaccatcagacgtattcctagaatggcacaatctggctatcagaactggtaggtttagtccaaatgtaatgatgtgttctaaagtagtcgggctgagtcaaacagcagcttcttctcttgttcaaaattttgaacctggtaatgttgtcatttcatgatagatcatagatacattcttggtttcactatatcttagaaagtccagccaacagaagtactcaagtacaggtgaacctttcagtttagctggagacatgggcagcagtgtacaaagtctaatccacagctgtgaccctgtgagctgggggttgggcctgcctcggaggggatcgtgtcttttctgtttgtgcaattatcagtgcctaaagaacatgtgttataacagttatacacggtcaattattcaatccatcttttaacgtgtgtttggttgtacgtataagaagggatcaaagagggcggccacattttctataacatttggatgagagtcacacgagaacgagatgaacaccgaagtaattttttatgacagcatgatccaaaaaaatcgagagaacggtgttatccccgtctcatcctattttgatctcaaaccaaacacataattagtcaatgagcactgacttgatgtagaagaacttggtacatataccaggaaatgactctgacttgctgagatgccttgtagtccctcggtcccgtaaattatacagtagtatttaaacttcctcgcacaaaggaaaactatttgtttttgcatgccttgtaaattagctatcaagtttttttttaaaaaaaacgacctttgaaaaccagtaaggaggactcgttcggtattcagttttaaagttcaaggttaaaaatcgaactgacgtgcaaaacaccctgggggttaaaatcaaaacacacaaatttggaaaatgagcaggcatgacttatgttgtgtccgttgaagtgccgtggctccatggcacggtggaactttacattagtgcggtagtgtcactgtggcagtaaagcccacttattttccattagagagagggagattaaaaacgtggctttacacattctgaaactaattgtgagtttgtgactcttggcttgcctgcagtgtccgcctgcaccttctataagtacagtcgcgagcctcagctatacaaaccaactagcgcatagtatctcctgagctccattcatcatcccaagtcttcactggtcttagatcaccctagtatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 156 - DNA, 15188 bp, Artificial Sequence
  RZ000002
gtttacccgccaatatatcctgtcaaacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgaattcgagctcggtacggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatggcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcctcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggataaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgaagcttgcatgcctgcatctagagaattccaccggtgttaacggcaaacgctaattagtcactaggcccaggaaacactaactaagccctagcttatcctagcgcaacctagttaggtcttggttaccggcctagaaggccgatctcccgggcacccagctttcttgtacaaagtggccgttaacggatcggccagaatggcccggaccgaagctttgtacagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcaagcttactaccagcagcatgatcagagtgaggatagttgctacttcaatggcctaggtttgataactactgtcgatccatctgtcgacaattgtttgtttcctctcacaattcacgtttctgccgccacttctttgcacctaacattgcccgtgtcgctgttattagttttgtggttttgcattgtctgtatatagtctgatgaggctatagattgagccttcaaaagtgtttcgttgggcctcttgttgaatgtactccaaagtctcggtgcaccatcagacgtattcctagaatggcacaatctggctatcagaactggtaggtttagtccaaatgtaatgatgtgttctaaagtagtcgggctgagtcaaacagcagcttcttctcttgttcaaaattttgaacctggtaatgttgtcatttcatgatagatcatagatacattcttggtttcactatatcttagaaagtccagccaacagaagtactcaagtacaggtgaacctttcagtttagctggagacatgggcagcagtgtacaaagtctaatccacagctgtgaccctgtgagctgggggttgggcctgcctcggaggggatcgtgtcttttctgtttgtgcaattatcagtgcctaaagaacatgtgttataacagttatacacggtcaattattcaatccatcttttaacgtgtgtttggttgtacgtataagaagggatcaaagagggcggccacattttctataacatttggatgagagtcacacgagaacgagatgaacaccgaagtaattttttatgacagcatgatccaaaaaaatcgagagaacggtgttatccccgtctcatcctattttgatctcaaaccaaacacataattagtcaatgagcactgacttgatgtagaagaacttggtacatataccaggaaatgactctgacttgctgagatgccttgtagtccctcggtcccgtaaattatacagtagtatttaaacttcctcgcacaaaggaaaactatttgtttttgcatgccttgtaaattagctatcaagtttttttttaaaaaaaacgacctttgaaaaccagtaaggaggactcgttcggtattcagttttaaagttcaaggttaaaaatcgaactgacgtgcaaaacaccctgggggttaaaatcaaaacacacaaatttggaaaatgagcaggcatgacttatgttgtgtccgttgaagtgccgtggctccatggcacggtggaactttacattagtgcggtagtgtcactgtggcagtaaagcccacttattttccattagagagagggagattaaaaacgtggctttacacattctgaaactaattgtgagtttgtgactcttggcttgcctgcagtgtccgcctgcaccttctataagtacagtcgcgagcctcagctatacaaaccaactagcgcatagtatctcctgagctccattcatcatcccaagtcttcactggtcttagatcaccctagtatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 157 - DNA, 14675 bp, Artificial Sequence
  RZ000003
gtttacccgccaatatatcctgtcaaacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgaattcgagctcggtacggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggataaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgaagcttgcatgcctgcatctagagaattccaccggtgttaacggcaaacgctaattagtcactaggcccaggaaacactaactaagccctagcttatcctagcgcaacctagttaggtcttggttaccggcctagaaggccgatctcccgggcacccagctttcttgtacaaagtggccgttaacggatcggccagaatggcccggaccgaagctttgtacagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcaagcttactaccagcagcatgatcagagtgaggatagttgctacttcaatggcctaggtttgataactactgtcgatccatctgtcgacaattgtttgtttcctctcacaattcacgtttctgccgccacttctttgcacctaacattgcccgtgtcgctgttattagttttgtggttttgcattgtctgtatatagtctgatgaggctatagattgagccttcaaaagtgtttcgttgggcctcttgttgaatgtactccaaagtctcggtgcaccatcagacgtattcctagaatggcacaatctggctatcagaactggtaggtttagtccaaatgtaatgatgtgttctaaagtagtcgggctgagtcaaacagcagcttcttctcttgttcaaaattttgaacctggtaatgttgtcatttcatgatagatcatagatacattcttggtttcactatatcttagaaagtccagccaacagaagtactcaagtacaggtgaacctttcagtttagctggagacatgggcagcagtgtacaaagtctaatccacagctgtgaccctgtgagctgggggttgggcctgcctcggaggggatcgtgtcttttctgtttgtgcaattatcagtgcctaaagaacatgtgttataacagttatacacggtcaattattcaatccatcttttaacgtgtgtttggttgtacgtataagaagggatcaaagagggcggccacattttctataacatttggatgagagtcacacgagaacgagatgaacaccgaagtaattttttatgacagcatgatccaaaaaaatcgagagaacggtgttatccccgtctcatcctattttgatctcaaaccaaacacataattagtcaatgagcactgacttgatgtagaagaacttggtacatataccaggaaatgactctgacttgctgagatgccttgtagtccctcggtcccgtaaattatacagtagtatttaaacttcctcgcacaaaggaaaactatttgtttttgcatgccttgtaaattagctatcaagtttttttttaaaaaaaacgacctttgaaaaccagtaaggaggactcgttcggtattcagttttaaagttcaaggttaaaaatcgaactgacgtgcaaaacaccctgggggttaaaatcaaaacacacaaatttggaaaatgagcaggcatgacttatgttgtgtccgttgaagtgccgtggctccatggcacggtggaactttacattagtgcggtagtgtcactgtggcagtaaagcccacttattttccattagagagagggagattaaaaacgtggctttacacattctgaaactaattgtgagtttgtgactcttggcttgcctgcagtgtccgcctgcaccttctataagtacagtcgcgagcctcagctatacaaaccaactagcgcatagtatctcctgagctccattcatcatcccaagtcttcactggtcttagatcaccctagtatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 158 - DNA, 14660 bp, Artificial Sequence
  RZ000004
gtttacccgccaatatatcctgtcaaacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgaattcgagctcggtacggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatgatcgggctgtccatgattaagaactggctgcggagccaaccggcgcccggtggaggcggcagcggtggcggaggctccggaggcggtggcgacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggataaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgaagcttgcatgcctgcatctagagaattccaccggtgttaacggcaaacgctaattagtcactaggcccaggaaacactaactaagccctagcttatcctagcgcaacctagttaggtcttggttaccggcctagaaggccgatctcccgggcacccagctttcttgtacaaagtggccgttaacggatcggccagaatggcccggaccgaagctttgtacagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcaagcttactaccagcagcatgatcagagtgaggatagttgctacttcaatggcctaggtttgataactactgtcgatccatctgtcgacaattgtttgtttcctctcacaattcacgtttctgccgccacttctttgcacctaacattgcccgtgtcgctgttattagttttgtggttttgcattgtctgtatatagtctgatgaggctatagattgagccttcaaaagtgtttcgttgggcctcttgttgaatgtactccaaagtctcggtgcaccatcagacgtattcctagaatggcacaatctggctatcagaactggtaggtttagtccaaatgtaatgatgtgttctaaagtagtcgggctgagtcaaacagcagcttcttctcttgttcaaaattttgaacctggtaatgttgtcatttcatgatagatcatagatacattcttggtttcactatatcttagaaagtccagccaacagaagtactcaagtacaggtgaacctttcagtttagctggagacatgggcagcagtgtacaaagtctaatccacagctgtgaccctgtgagctgggggttgggcctgcctcggaggggatcgtgtcttttctgtttgtgcaattatcagtgcctaaagaacatgtgttataacagttatacacggtcaattattcaatccatcttttaacgtgtgtttggttgtacgtataagaagggatcaaagagggcggccacattttctataacatttggatgagagtcacacgagaacgagatgaacaccgaagtaattttttatgacagcatgatccaaaaaaatcgagagaacggtgttatccccgtctcatcctattttgatctcaaaccaaacacataattagtcaatgagcactgacttgatgtagaagaacttggtacatataccaggaaatgactctgacttgctgagatgccttgtagtccctcggtcccgtaaattatacagtagtatttaaacttcctcgcacaaaggaaaactatttgtttttgcatgccttgtaaattagctatcaagtttttttttaaaaaaaacgacctttgaaaaccagtaaggaggactcgttcggtattcagttttaaagttcaaggttaaaaatcgaactgacgtgcaaaacaccctgggggttaaaatcaaaacacacaaatttggaaaatgagcaggcatgacttatgttgtgtccgttgaagtgccgtggctccatggcacggtggaactttacattagtgcggtagtgtcactgtggcagtaaagcccacttattttccattagagagagggagattaaaaacgtggctttacacattctgaaactaattgtgagtttgtgactcttggcttgcctgcagtgtccgcctgcaccttctataagtacagtcgcgagcctcagctatacaaaccaactagcgcatagtatctcctgagctccattcatcatcccaagtcttcactggtcttagatcaccctagtatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 159 - DNA, 14642 bp, Artificial Sequence
  RZ000005
gtttacccgccaatatatcctgtcaaacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgaattcgagctcggtacggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatggcggagccgaagctggaggacttcctcggcggtggaggcggcagcggtggcggaggctccggaggcggtggcgacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggataaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgaagcttgcatgcctgcatctagagaattccaccggtgttaacggcaaacgctaattagtcactaggcccaggaaacactaactaagccctagcttatcctagcgcaacctagttaggtcttggttaccggcctagaaggccgatctcccgggcacccagctttcttgtacaaagtggccgttaacggatcggccagaatggcccggaccgaagctttgtacagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcaagcttactaccagcagcatgatcagagtgaggatagttgctacttcaatggcctaggtttgataactactgtcgatccatctgtcgacaattgtttgtttcctctcacaattcacgtttctgccgccacttctttgcacctaacattgcccgtgtcgctgttattagttttgtggttttgcattgtctgtatatagtctgatgaggctatagattgagccttcaaaagtgtttcgttgggcctcttgttgaatgtactccaaagtctcggtgcaccatcagacgtattcctagaatggcacaatctggctatcagaactggtaggtttagtccaaatgtaatgatgtgttctaaagtagtcgggctgagtcaaacagcagcttcttctcttgttcaaaattttgaacctggtaatgttgtcatttcatgatagatcatagatacattcttggtttcactatatcttagaaagtccagccaacagaagtactcaagtacaggtgaacctttcagtttagctggagacatgggcagcagtgtacaaagtctaatccacagctgtgaccctgtgagctgggggttgggcctgcctcggaggggatcgtgtcttttctgtttgtgcaattatcagtgcctaaagaacatgtgttataacagttatacacggtcaattattcaatccatcttttaacgtgtgtttggttgtacgtataagaagggatcaaagagggcggccacattttctataacatttggatgagagtcacacgagaacgagatgaacaccgaagtaattttttatgacagcatgatccaaaaaaatcgagagaacggtgttatccccgtctcatcctattttgatctcaaaccaaacacataattagtcaatgagcactgacttgatgtagaagaacttggtacatataccaggaaatgactctgacttgctgagatgccttgtagtccctcggtcccgtaaattatacagtagtatttaaacttcctcgcacaaaggaaaactatttgtttttgcatgccttgtaaattagctatcaagtttttttttaaaaaaaacgacctttgaaaaccagtaaggaggactcgttcggtattcagttttaaagttcaaggttaaaaatcgaactgacgtgcaaaacaccctgggggttaaaatcaaaacacacaaatttggaaaatgagcaggcatgacttatgttgtgtccgttgaagtgccgtggctccatggcacggtggaactttacattagtgcggtagtgtcactgtggcagtaaagcccacttattttccattagagagagggagattaaaaacgtggctttacacattctgaaactaattgtgagtttgtgactcttggcttgcctgcagtgtccgcctgcaccttctataagtacagtcgcgagcctcagctatacaaaccaactagcgcatagtatctcctgagctccattcatcatcccaagtcttcactggtcttagatcaccctagtatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 160 - DNA, 14732 bp, Artificial Sequence
  RZ000006
gtttacccgccaatatatcctgtcaaacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgaattcgagctcggtacggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatggcggagccgaagctggaggacttcctcggcggtggaggcggcagcggtggcggaggctccggaggcggtggcatcgggctgtccatgattaagaactggctgcggagccaaccggcgcccggtggaggcggcagcggtggcggaggctccggaggcggtggcgacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggataaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgaagcttgcatgcctgcatctagagaattccaccggtgttaacggcaaacgctaattagtcactaggcccaggaaacactaactaagccctagcttatcctagcgcaacctagttaggtcttggttaccggcctagaaggccgatctcccgggcacccagctttcttgtacaaagtggccgttaacggatcggccagaatggcccggaccgaagctttgtacagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcaagcttactaccagcagcatgatcagagtgaggatagttgctacttcaatggcctaggtttgataactactgtcgatccatctgtcgacaattgtttgtttcctctcacaattcacgtttctgccgccacttctttgcacctaacattgcccgtgtcgctgttattagttttgtggttttgcattgtctgtatatagtctgatgaggctatagattgagccttcaaaagtgtttcgttgggcctcttgttgaatgtactccaaagtctcggtgcaccatcagacgtattcctagaatggcacaatctggctatcagaactggtaggtttagtccaaatgtaatgatgtgttctaaagtagtcgggctgagtcaaacagcagcttcttctcttgttcaaaattttgaacctggtaatgttgtcatttcatgatagatcatagatacattcttggtttcactatatcttagaaagtccagccaacagaagtactcaagtacaggtgaacctttcagtttagctggagacatgggcagcagtgtacaaagtctaatccacagctgtgaccctgtgagctgggggttgggcctgcctcggaggggatcgtgtcttttctgtttgtgcaattatcagtgcctaaagaacatgtgttataacagttatacacggtcaattattcaatccatcttttaacgtgtgtttggttgtacgtataagaagggatcaaagagggcggccacattttctataacatttggatgagagtcacacgagaacgagatgaacaccgaagtaattttttatgacagcatgatccaaaaaaatcgagagaacggtgttatccccgtctcatcctattttgatctcaaaccaaacacataattagtcaatgagcactgacttgatgtagaagaacttggtacatataccaggaaatgactctgacttgctgagatgccttgtagtccctcggtcccgtaaattatacagtagtatttaaacttcctcgcacaaaggaaaactatttgtttttgcatgccttgtaaattagctatcaagtttttttttaaaaaaaacgacctttgaaaaccagtaaggaggactcgttcggtattcagttttaaagttcaaggttaaaaatcgaactgacgtgcaaaacaccctgggggttaaaatcaaaacacacaaatttggaaaatgagcaggcatgacttatgttgtgtccgttgaagtgccgtggctccatggcacggtggaactttacattagtgcggtagtgtcactgtggcagtaaagcccacttattttccattagagagagggagattaaaaacgtggctttacacattctgaaactaattgtgagtttgtgactcttggcttgcctgcagtgtccgcctgcaccttctataagtacagtcgcgagcctcagctatacaaaccaactagcgcatagtatctcctgagctccattcatcatcccaagtcttcactggtcttagatcaccctagtatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 161 - DNA, 2079 bp, Oryza sativa
atggccaccatgaacaactggctggccttctccctctccccgcaggatcagctcccgccgtctcagaccaactccactctcatctccgccgccgccaccaccaccaccgccggcgactcctccaccggcgacgtctgcttcaacatcccccaagattggagcatgaggggatcggagctctcggcgctcgtcgccgagccgaagctggaggacttcctcggcggcatctccttctcggagcagcagcatcatcacggcggcaagggcggcgtgatcccgagcagcgccgccgcttgctacgcgagctccggcagcagcgtcggctacctgtaccctcctccaagctcatcctcgctccagttcgccgactccgtcatggtggccacctcctcgcccgtcgtcgcccacgacggcgtcagcggcggcggcatggtgagcgccgccgccgccgcggcggccagtggcaacggcggcattggcctgtccatgatcaagaactggctccggagccagccggcgccgcagccggcgcaggcgctgtctctgtccatgaacatggcggggacgacgacggcgcagggcggcggcgccatggcgctcctcgccggcgcaggggagcgaggccggacgacgcccgcgtcagagagcctgtccacgtcggcgcacggagcgacgacggcgacgatggctggtggtcgcaaggagattaacgaggaaggcagcggcagcgccggcgccgtggttgccgtcggctcggagtcaggcggcagcggcgccgtggtggaggccggcgcggcggcggcggcggcgaggaagtccgtcgacacgttcggccagagaacatcgatctaccgcggcgtgacaaggcatagatggacagggaggtatgaggctcatctttgggacaacagctgcagaagagagggccaaactcgcaagggtcgtcaaggtggttatgacaaagaggaaaaagctgctagagcttatgatttggctgctctcaaatactggggcccgacgacgacgacaaattttccggtaaataactatgaaaaggagctggaggagatgaagcacatgacaaggcaggagttcgtagcctctttgagaaggaagagcagtggtttctccagaggtgcatccatttaccgtggagtaactaggcatcaccagcatgggagatggcaagcaaggataggaagagttgcagggaacaaggacctctacttgggcaccttcagcacgcaggaggaggcggcggaggcgtacgacatcgcggcgatcaagttccgggggctcaacgccgtcaccaacttcgacatgagccgctacgacgtcaagagcatcctcgacagcgctgccctccccgtcggcaccgccgccaagcgcctcaaggacgccgaggccgccgccgcctacgacgtcggccgcatcgcctcgcacctcggcggcgacggcgcctacgccgcgcattacggccaccaccaccactcggccgccgccgcctggccgaccatcgcgttccaggcggcggcggcgccgccgccgcacgccgccgggctttaccacccgtacgcgcagccgctgcgtgggtggtgcaagcaggagcaggaccacgccgtgatcgcggcggcgcacagcctgcaggatctccaccacctcaacctcggcgccgccgccgccgcgcatgacttcttctcgcaggcgatgcagcagcagcacggcctcggcagcatcgacaacgcgtcgctcgagcacagcaccggctccaactccgtcgtctacaacggcgacaatggcggcggaggcggcggctacatcatggcgccgatgagcgccgtgtcggccacggccaccgcggtggcgagcagccacgatcacggcggcgacggcgggaagcaggtgcagatggggtacgacagctacctcgtcggcgcagacgcctacggcggcggcggcgccgggaggatgccatcctgggcgatgacgccggcgtcggcgccggccgccacgagcagcagcgacatgaccggagtctgccatggcgcacagctcttcagcgtctggaacgacacataa

SEQ ID NO: 162 - protein, 692 aa, Oryza sativa
MATMNNWLAFSLSPQDQLPPSQTNSTLISAAATTTTAGDSSTGDVCFNIPQDWSMRGSELSALVAEPKLEDFLGGISFSEQQHHHGGKGGVIPSSAAACYASSGSSVGYLYPPPSSSSLQFADSVMVATSSPVVAHDGVSGGGMVSAAAAAAASGNGGIGLSMIKNWLRSQPAPQPAQALSLSMNMAGTTTAQGGGAMALLAGAGERGRTTPASESLSTSAHGATTATMAGGRKEINEEGSGSAGAVVAVGSESGGSGAVVEAGAAAAAARKSVDTFGQRTSIYRGVTRHRWTGRYEAHLWDNSCRREGQTRKGRQGGYDKEEKAARAYDLAALKYWGPTTTTNFPVNNYEKELEEMKHMTRQEFVASLRRKSSGFSRGASIYRGVTRHHQHGRWQARIGRVAGNKDLYLGTFSTQEEAAEAYDIAAIKFRGLNAVTNFDMSRYDVKSILDSAALPVGTAAKRLKDAEAAAAYDVGRIASHLGGDGAYAAHYGHHHHSAAAAWPTIAFQAAAAPPPHAAGLYHPYAQPLRGWCKQEQDHAVIAAAHSLQDLHHLNLGAAAAAHDFFSQAMQQQHGLGSIDNASLEHSTGSNSVVYNGDNGGGGGGYIMAPMSAVSATATAVASSHDHGGDGGKQVQMGYDSYLVGADAYGGGGAGRMPSWAMTPASAPAATSSSDMTGVCHGAQLFSVWNDT

SEQ ID NO: 163 - DNA, 1794 bp, Oryza sativa
atggccaccatgaacaactggctggccttctccctctccccgcaggatcagctcccgccgtctcagaccaactccactttcatctccgccgccgccaccaccaccaccgccggcgactcctccaccggcgacgtctgcttcaacatcccccaagctcacccctccacgccggccattggcaacggcggcattggcctgtccatgatcaagaactggctccggagccagccggcgccgcagccggcgcaggcgctgtctctgtccatgaacatggcggggacgacgacggcgcagggcggcggcgccatggcgctcctcgccggcgcaggggagcgaggccggacgacgcccgcgtcagagagcctgtccacgtcggcgcacggagcgacgacggcgacgatggctggtggtcgcaaggagattaacgaggaaggcagcggcagcgccggcgccgtggttgccgtcggctcggagtcaggcggcagcggcgccgtggtggaggccggcgcggcggcggcggcggcgaggaagtccgtcgacacgttcggccagagaacatcgatctaccgcggcgtgacaaggcatagatggacagggaggtatgaggctcatctttgggacaacagctgcagaagagagggccaaactcgcaagggtcgtcaaggtggttatgacaaagaggaaaaagctgctagagcttatgatttggctgctctcaaatactggggcccgacgacgacgacaaattttccggtaaataactatgaaaaggagctggaggagatgaagcacatgacaaggcaggagttcgtagcctctttgagaaggaagagcagtggtttctccagaggtgcatccatttaccgtggagtaactaggcatcaccagcatgggagatggcaagcaaggataggaagagttgcagggaacaaggacctctacttgggcaccttcagcacgcaggaggaggcggcggaggcgtacgacatcgcggcgatcaagttccgggggctcaacgccgtcaccaacttcgacatgagccgctacgacgtcaagagcatcctcgacagcgctgccctccccgtcggcaccgccgccaagcgcctcaaggacgccgaggccgccgccgcctacgacgtcggccgcatcgcctcgcacctcggcggcgacggcgcctacgccgcgcattacggccaccaccaccactcggccgccgccgcctggccgaccatcgcgttccaggcggcggcggcgccgccgccgcacgccgccgggctttaccacccgtacgcgcagccgctgcgtgggtggtgcaagcaggagcaggaccacgccgtgatcgcggcggcgcacagcctgcaggatctccaccacctcaacctcggcgccgccgccgccgcgcatgacttcttctcgcaggcgatgcagcagcagcacggcctcggcagcatcgacaacgcgtcgctcgagcacagcaccggctccaactccgtcgtctacaacggcgacaatggcggcggaggcggcggctacatcatggcgccgatgagcgccgtgtcggccacggccaccgcggtggcgagcagccacgatcacggcggcgacggcgggaagcaggtgcagatggggtacgacagctacctcgtcggcgcagacgcctacggcggcggcggcgccgggaggatgccatcctgggcgatgacgccggcgtcggcgccggccgccacgagcagcagcgacatgaccggagtctgccatggcgcacagctcttcagcgtctggaacgacacataa

SEQ ID NO: 164 - protein, 597 aa, Oryza sativa
MATMNNWLAFSLSPQDQLPPSQTNSTFISAAATTTTAGDSSTGDVCFNIPQAHPSTPAIGNGGIGLSMIKNWLRSQPAPQPAQALSLSMNMAGTTTAQGGGAMALLAGAGERGRTTPASESLSTSAHGATTATMAGGRKEINEEGSGSAGAVVAVGSESGGSGAVVEAGAAAAAARKSVDTFGQRTSIYRGVTRHRWTGRYEAHLWDNSCRREGQTRKGRQGGYDKEEKAARAYDLAALKYWGPTTTTNFPVNNYEKELEEMKHMTRQEFVASLRRKSSGFSRGASIYRGVTRHHQHGRWQARIGRVAGNKDLYLGTFSTQEEAAEAYDIAAIKFRGLNAVTNFDMSRYDVKSILDSAALPVGTAAKRLKDAEAAAAYDVGRIASHLGGDGAYAAHYGHHHHSAAAAWPTIAFQAAAAPPPHAAGLYHPYAQPLRGWCKQEQDHAVIAAAHSLQDLHHLNLGAAAAAHDFFSQAMQQQHGLGSIDNASLEHSTGSNSVVYNGDNGGGGGGYIMAPMSAVSATATAVASSHDHGGDGGKQVQMGYDSYLVGADAYGGGGAGRMPSWAMTPASAPAATSSSDMTGVCHGAQLFSVWNDT

SEQ ID NO: 165 - DNA, 1635 bp, Zea mays
atgctgcatcaggagaacagtgaggctttcgggaggcaccactctgagcagcttgcatgtgtcaacatgaggggagcagataatggtcatccgaatttccttcctgagaaatgccagattgcagtttgtcctgaagttcaccaaaggggtgaaaaagttggactatttgatgaagagctggtacatggtattcatctaaccagtccttgtgttcagtcaccatttttgccaagtggtgtcaaagaaacacctatagtggatcataacaagagacctgcatccagtgacatactggacatagttgaatgcaaacggctgaagcaggaagatcaaatcgttactaaggaagacaaccatacatctgctgaggaggaatttcatgactaccccacatacacgacttgcgaaagaagctttgactcaccactatatgagagtgaggaaagtgaagatgagggcgtagattcacctctccattgttcacatgctcgcacctatgttgaagatggtctatggcctgccagctttcatcaatctgttggccctttttccttgaggaaacctgttcctatcgggtcaaatcatcaggctgaattacctgagtgcaggccatttggtggaagaactgaagaagacgaaagtgtcaagtggatcagaaacagtgttgtgccaatgcctggtactgatgcatcgtctttggtgttggagcctgttcactgcaaagcaggttgtgattgtcttgacgaaggttcaatcaattgtgtgaaaaagcatgtgatggaagcaagagaaaatttgaaggattctgttggtgcagacgccttcagggagttgggtttctatgacatgggggaagaggttgcctcaaggtggtcagaagaggaggaacgtttgttccagcaagtggtctcgtcaaaccgtgcttctctgcgcaggaacttttgggatgaacttcctcttgccttcccttccaagtccagcaaagagctagtgagctactacttcaatgtcttcatgttgaggaagagggctgagcagaacaggttcgacccagcgaacattgacagtgacgacgatgagtggcaggcaggtggtgattttgagtttccaataacaggaagaactgatgaatacatgccaatcgagtcccttactgatcaagatgatgttgcttgcaatccatttcccttggagggggatttatatggagattctgatgatgaggacgagcttgacaattccagtggagacaggcataatggtgtgcagagggctggtatgttgtcagagggtcatcccgaaatgtcatttatagatcatgatcaacagacgttgaagctagatgcagatgcacaagatgactcttgcacatcatttgaggctcatcaggttggttgcgatggtggggcacatactgatattggcaatcactacaggagtgacgacggcctttgtggtggtgcagaacatgggttctttggtgaccattgtgacacaaaagagtggggcttcggtttcagtactggttgggagaggcatgattttttgtcaacgaacaatgtcatagaagaggtgttcgggaagggctccagtgaagatggaagtgacactgctactggccaggaccttatctga

SEQ ID NO: 166 - DNA, 2055 bp, Zea mays
atggtgttccaaaagaggtcctcgtcagagttggaggcgtccggtggaggccaagtcgcggagatgccgcgcgttcccaagtctgcgaggggcaagagatcggtcaggaagaaggaggcccagaacccgccccagatgtcagcattcgaccttctcgcgacggtggcagggaagctgcttgatgagggggtgggctcgctggggaacatgagcgctggtgccccagctttgactgcatgcgcgaaggatgtccgtgtgaagaaggagcagtgtgacgaggaaatgaagcagttcaagcatgaggtgacagatcaggatagctgcaatgagagtgcaattctcccgcacattgtgttccagcgggcggtgaataatgctcggaatgaggatcctaaggcgaagtctgaggcccaggacaaggaatcctccatgatcagctgtaccaaggctgaactgggttgtaattttggtgtgattgcagataggtggtcgcctgaatccgtggaatcaggagccttcacaggagatgcagtggcgagcctgatgccacctgccccagcaggatttcataagaatgcacccgaaatgtataatttgcttgattcaatggatgtggatgtcaagcctcctcctttggtcagctctgacagcaccggcgagatgccattgtatggcgataaagttcaccgctcaacctccttaccaagggtctcgaagggagtggggttttttgctgtagatagagatgatgacgacgataagtcctctgggtgcactcatcccagcaccaccactaacaaggatttcaggtccaattgtacagctgagtatagtagggtaaggaagttgctcaccagtaagtacaggaaagttgctccagcgagggtttacaaatctgatctttcctatagtgatgttgatcggaagccttctttccggaacaaaaaaatgcattatacacgacagaggacacaaaggagtacattcaagcgtaggaagctctttgatcgccattcagttctagcatctgaatttggtaccgcacatggaaagggaaacacgaagaaggttaccggaagagactcccatgctgtgtctttggaagcaaacaaggggactagttcaacgccattccagaaatctcgtgggtcaaatgattgccatgtgaaacttaaaattaagtcttttaaggtgcctgaacttcttgttgaaatcccagaaagtgcaactgttggctcactaaagaaaactgttctcgaggcagtgactgcgattctcggaggtggtctacgtgttggtgttcttcaccatggaaagaaagttagagatgataataaaacgttgattcaggctggtattggtcaggaggatatgctggacaaccttggcttttcacttgaacccaactgtacacaaaacccacaagtccaagctcctgaagatatcagtttcctggaaaccattgatactgctgaacccctcgcaaggattgcacctgctgactcgtcttctaagcatggtgaagttgacctatcacaggagtttgcattaaccccattagcaatgaactaccagggcagtgatcatgattctgtgcactcccctgggggcgtctcatcgcccgataaagtctccacaaactcgcgagctttagttccagttccagctgcagatcccaatgcaggagctatagttccagcgaataagtctaagaggtcaccagagcaggggcaacgcagaatcaggcgcccgttctctgttgctgaagtagaagcacttgtgctcgcagtcgaaaagcttggaaccggaaggtggcgagatgttaaacttcgcgcgtttgacaatgcgaagcaccgtacctatgttgatcttaaggacaaatggaagacgctggtgcacaccgcgagcatctcgccgcagcagcggcgtggcgagccggtgcctcaggagctgctcgaccgggtcctggcggcccaggcctactggtcccagcagcaagccaagctccagcctaagacgcccccgctgctggctgaggctcgcttgctcacctaa

SEQ ID NO: 167 - DNA, 1818 bp, Zea mays
atgcacgccggcacgaggccaagtcatcgacacgagtacggcaccctggcccaccccacaagccacacatcgccgatccaacgcccgcccgcatcgcgacgaacactgtcagcttccgatccgcgtgttgtcgtccaaagactgcatccctcccccctctccagtctccacccagaacacaagcaggcagcagccgatcggactcggctagtttcgccggccgcctccaactggtcctccgctgggcgcgagggctctttctctaggcccgtagatctgcgctgctgcgccctcgttgtcgtgaaaatcactatccgtctcttggatcgagcgatcctcccattcgcggcttcgccccacacgagtcgttccaaggagccgaaatttccagcccgcccggcaggggcaggcggtacggggattcgggctctgccctgcttttatcagcaactccactggccgctgaggttctgtaggagggcggtgcaccggtggggccaggggagcatgatgagggggcacacgtggctggcgcttctggtcgtggtggtgctcgcgttggcggacgcggcggcggggaggttcgtggtggagaagaacagcatccaggtgacgtcccccgacgagctcaagggcaagtacgagtgcgccatcggcaacttcggggtgccgcagtacgggggcaccctgcacggattggtcgagtacccaaagtccaaccggaaggcgtgccagagcttcgacatctcgttcaagcccaagcaggccgggggacgacccaccttcgtcctcgtcgaccgcggagaatgcttcttcacaaccaaggcatggaatgcacaaaacgctggagctgctgccgttcttgttgtggatgacaagtcggaacctctaatcacaatggacaacccagaagaaggcaaagagcacctagaaaacatcactattccctcagtgcttataacaaagaaattgggggaaagccttaagaaatccgcggaaaatggcgatatgcttagcgttcttctagactggagagaatcccttccccatccggatgagcgtgtagagtatgagttctggacaaacagtaatgatgaatgtggtcctaaatgtgatatgcaaatggacttcgtgaagagctttagaggaactgcacaaatccttgagaaaaagggttacactcagtttactcctcattatatcacatggtattgtccagaagcttttgtcgatagcaagcaatgcaaatcacagtgcatcaatcatgggagatattgtgcaccagacccagagcaggattttagtcaagggtatgatggaagaaatgttgtggttcaaaatctacatcaaatttgtgtattcaagattgctaatgaaactggaaagccatggctgtggtgggattatgtgcatgatttcgcacttaggtgcccaatgaaggataagaaatacaatcatgactgtgccagcgatgttatcaagtcacttggattggacatcgagaaaataaacaagtgtgttggcgaccctgaagccaatgaggaaaacgtaattttaaaggcagaacaagatgcccaaattggtcatggtaaaaggggagatgtcacaatactaccaacccttgtcatcaacaacaggcaatacagaggtaagctggacaaagttgctgtcctgaaagcgatttgttcaggattcgaggagacaactgagcctgctgtttgtttgagcgaagaggttcaaacaaatgagtgtttggagaacaatgggggttgctggctggacaaagctaataatgttactgcatgcaaggtacaattt

SEQ ID NO: 168 - DNA, 2379 bp, Zea mays
atgggaataaaagttgagggtgagacctatattccaggatactttgacatggaagattctagtgtaaattataatggcaatgtgctgccgtatcacaaggagaacaaaccaagtgtgtttcttactgagaagttcacaataatagcttcaaatggacgagtacattacgacaaggaaatgataaagcggacaatgcttgtacatgaagctacattccggaaacaggtatatgaacttcaccagctttacaaaattcagaaggaactaatggcacggttccaaatagaagagatcaatggttgtcctagttatgctggtttattgcagccaagatcctctccatcacaggcactgcttgatgatgttaaaggaatgcgaaaaactgtgaatcctatttctggacatgatcctaagcagtcatgcatcgatttgataaatgaaagtagttcacaatatagtgtgagtggaactcctttgaggcataacaatgttaggcctcaaaagaaaatgattgacctgcaggttccagcagatgtatacactgacaatgatgatgatgtggagatattagaagtgaggccttccaaaagattgcctggggctaatgggtctgttcttttaggaaatgtcaacctcagccttcaaaatagtgagggctattcacatatgaagagttggagtactgatatacaagcacatcacagctcaactgcgcatatactgaataaaccagttgaagattcatctagtatgaatagatctaattttcttggtgtgggaatatctgctctgcagaaccatcattatgcatcacagggagtaaacttgaaccccataagcttggaagcaaaactaaaggaacaatgtgctggtaaagcatctggttcaaggttctttggaacaaatgaggaaataaggaacaacaatccatttcaacacagaaaggatgactccaactctagcatggcattgtacaaacaaaattgcattggttcctcaatggggaattacgctcccaatgctagcaccttcaatcactccattctttctccgcttggcttcaaccatgcactgaatcttccatggcaaagcaacaacacgagctacttgactaagagtcattgtggtgctgctgaaacattcattcctaaggatgccctttccaatggtatctcagtggattctactccaaaggcgccctatcatcattcactaaagattcacggaggtgccggatatcaaaaacctcctgcactacatgataacctgaaggatatagatctgaatgacacaccagttgatgtcgctgccacttgggaacagggaagcgagaaatcagtggttgatatctcttggctcagcaagaaaccagtaagcctgatggaatcacaagtcccatcaagttatgcaaaggaccactcccagattttgccaagccccacattatattcagaaagtagaactcccacaagagttcctgccttccctttcagtgttggtgctgaaaaagattctcggtgctcacccactctactatatgacctaaacaatggaccatcgattaagcatgaaactgacatggaaattcagtccctgtgcaaggaaagtgacacagatactaggaatctcattgacctgaatgaaaccttgccaataatcgacgatccagaaatagagtctcatgaatcaggtgaaattgttcctcatgaacccaatggcccttcacaggattctatcgctatagcagcagcagcagagacgttggtagaaatgtggaataatagtgatcggcctgcatatcaaccggacattttgcattggtttgctgacctagctatatccaaagataacacattgttggacaaggacagcgatgacgactttgaggctgcaacactgaagctgcgagaaacaaagagcaacgagtaccattcaacaccaagaaccacccaggaggataacactaactttggtcattgctctgcagcttcacttgtctcaaaacctcagagaggtagagggcgaggacgccgacagaggaaacactttcagagggacatcttgccaggccttgcgtcattgccaaagcacgaggtatcagaggatcttcgtgcgctcggaaggtccaagctagtcaccccgacgaaacgtggccgtaacaggcagcaaccgagagggaggcgtcgggcaagaagcgtggctgtcgccatggaggtagaggaaagcgaggtcagcccaccactgcaggcatcaccatctcctgtccctgctgacttggacgcagatgcattggcaataacaaggtggggaaggaccaccagacgttgtcgaaggccgagatgcccgccggtgaacaatgcatcgctgcgtgtagcttga

SEQ ID NO: 169 - DNA, 1050 bp, Zea mays
atgcctttggaaattcaagatagtgaggttgacatagtgattgcggcactccagcccaacctgaccactttctttgaggcatggcgaccatttttctcccgtttccacatcattgtcgtcaaagatccagacatggcagaggatcttcaaatccctgcaggttttgatctcaaggtttacaccaagtcagatattaatgggttgcttggtgcctcctcatccataaacttatctggtcactcatgccgttactttgggtatcttgtctcacgcaagaagtatgtgatttcaattgatgacaattgcctcccagcgaaggacactgctgggtcgactgttgatgttgttgcacagcacatggccaatctgaaaacacctgctacacctttctttttcaacacactctatgatccatacaggaaaggtgctgactttgtccgtggttacccattcagcctgcgcgagggggttgagtgcatgctctcgtgtggtttgtggcttcataatgctgactacgacccgatgactcatgttgtgaagagaaatcaacggaacacaacatatgtggatgctgtgatgacggttccgcttggtgccatgctgcctgtgagcgggataaatgttgcattcaaccgcgatgtgctggggcctgctatgttcccaggcctgcgtctacgaaacgaagggaagcacagatgggatacccttgaagacatatggaatggcttatgtgctaaagtagtctgcgacagcttgggatatggtgtgaagaccggactgccttatgtgatgagaagtgatgcagaagcaggtaaagctctggagagcttgaaagagtgggaaggggtaaaagtcatggatgatgttctcccattcttccagtcgctcaagctatcgaggactgcagttactgttgacgattgtgttaaggagcttgctggagttgtccgtgagaagctaggacctaagaatgcaatcttcaccaaagcagccgatgccatggtggaatggaacaatctctggaaagtgcatggtgctcagaatgcatag

SEQ ID NO: 170 - DNA, 1539 bp, Zea mays
atggcggcagctgcgctggcaatggcagagcaggtggtggccgagctccgagtgaggtgtgagacgccgccgtcgatgctgcgcgaggtggccgtggagatggcccgcgagatgggcgcggggctggagaaggacggcgggagcagggtcaagatgctcctctcctacgtcgataagctccccacagggagagaggaaggattattctatggattggacctaggaggaacgaatttccgcgtcttgaaagtgcaactaggtgggaatgcgaagcatgtcgttgaccgtgactccagagaagtcggcattccgccacatctgatgtcagggagctcctcggagctttttggtttcattgcttctgaattggccaagtttgttgacgatgatgagaagtgcgctaacatttcgaatggcaagaagcgagaaatagggttcacgttttcgttcccagtgaagcagcgttctgtagcttccggtacgcttgtcaagtggacaaaggcattttccattaatgatgctgtaggcgaagatgtggtggctgaactgcaaacagccatggagaagcaaggtctggacatgcatgtagctgcattgattaatgatgctgttgggacgctggcgggagcaaggtactatgacaaagatgttgtcgctggtgtaatatttggcactggcacaaacgcagcatatgttgagaaggcaaatgctattccaaaatgggagggtgagctgccccattcaggagacatgaaaaaaaacgattttgctgtacttcaggtcatcaacatggaatggggtaacttcttctcatctcatctccccatcactgaatatgatcaagaattagataaggagagcttaaatccaggagaacagatttacgagaagttaacgtcaggaatgtatttaggtgaaattgtaaggagggtgctccttaaaatatcattgcagtccgccatttttggtgatattgaccacactaagcttcaaacccatttccttctgcggactccacatatttcagcaatgcaccatgacgaaacatctgatctgaagattgtggccgaaaattttgaagaaaacctagagattacaggcacatccttggaggctcgtaagctggtcgttgaaatctgtgacattgtggcgacaagagcagcccggctggctgctgcggggcttgcagggatcctcatgaagatcgggagagatcacagcgtcgaggaccaacggtcagtcatcgccatcgacggaggactgttcgagcactacaccaaattccgccggtgcttggagaccacactgggtgagctgctaggagacgaggcgtccaaggcggtggccatcaagcatgccgacgacggttcaggaataggtgctgccctgattgcagcttcacagtctcagtacaaaaacgacttagtggccgtcaagcatgcagatgacggttcaggagtcaagtatgcagaagacaagcgtgcagatgacggatcagaaataggtgctgccctgattgctgcctcgcaatctcagtag

SEQ ID NO: 171 - DNA, 384 bp, Zea mays
atgggctccgccgatcgcagtaagatcgacgggatcgtggtgccggagaaaggcgccaggagctgcgtcgaatgccgcgccaccaccacgcccatgtggcgcagcggccccaccgggcccaggtcactttgcaacgcttgcgggattcggtaccgaaagaagaggaggcaagagcttggcctagagcacaacaagcagcagcagcaacaacaaaataatggcgaggcgaagactggagtaaaagacagctctagcaacagcagtagcgggagcagcaactttcacgtggtgcagaaacggaggctcctaatggaagtggaggaggctgctctgctgctgatgaccctatcttcttcgcccgcatccacattgctacatggctag

SEQ ID NO: 172 - DNA, 465 bp, Zea mays
atggcgcccaaggcggagaagaagccggcggcgaagaaggtggcggaggaggagccctcggagaaggcggctccggcggagaaggcccccgcggggaagaagcccaaggcggagaagcggctacctgcgggcaagtccgccggcaaggagggcggcgacaagaagggtaggaagaaggcgaagaagagcgtggagacctacaagatctacatcttcaaggtcctgaagcaggtgcaccccgacatcggcatctcctccaaggccatgtccatcatgaactccttcatcaacgacatcttcgagaagctcgccgcggaggccgccaagctcgcccggtacaacaagaagcccaccatcacctcccgcgagatccagacctccgtccgcctcgtcctccccggcgagctcgccaagcacgccgtctcggagggtaccaaggccgtcaccaagttcacctcgtcttag

SEQ ID NO: 173 - DNA, 2028 bp, Zea mays
atggatgcagtggaactgccgttaccagccaaggtggagttcgggaaaatcctggcgcaggcagccgcggtggagggggtggacggaggcatccccggaggcgggggcggggaggtgctcaggcgctgcgccgacgcggaccggcggcacgatgtgaagcagcacaatcagaatgcagaaggctttccatctcatagaagtaaaaggatgtctttggaagtctctatgcagaaatctcttggttttggcttgaagtctgataatggcaaacatgattatgttgcaaatgatacggttcaatccctgcataagcaagatagtaagatagtgataaaaaagaccataaaattgttggacggtccaccttatccaaaaaggccaaagcttgagccagcacaaactggtagagatgctgaggctaagggacatgaattcatatcacagaagaatgtgcctgatttaacaccatgcacaacatctgaaaaatctcggttgctcaagcagaagcgcatttctgatggaaagagaactgataagaagaatattaggtctggtgtcagatcgaaacatgattgtttctcatcaaaggctggtttagcaaattttgattctggtttctcaggaaacagcgtgcttggagcacatggccttaaatctgatattcgtgacatcacacatcacattgagaacctgtcattgatcgaacttcttgatggcacttacaagtattccagtttaggaagagataaaggaaagaaggtattgcacacgaaggaggaactcctagtctctgtcagaaaaactttttctatgctttctgacatggactatcgccatggaaaggactctaatctcattctgagccctaaactttcttctgcaagtacttctagctgtgatatcaaagaacaatgtggtgacaagccacccctcttggttaaggacccatcacaaattaatctctgtgatagtgcactttgtcatccaaaagatatcttaagccgtttaactcttcctcatcgacaagatctagactctcttttagcacccggaagggagagcacagctgcagttaagccttatatgccttccatgacagttcatggagctagtttgccaccatttccttggtcacattcacaggctgggggctgtcgacaaggtgttgactgtggtaaacatggatcaagtaggagtaactcccagtggcaatgggtgcgggttggctccaacctcacttctctagatcatgaagacacgtctgtccatagaattgatgatctccttcaagagatggatgcagcaaaattatgtatattggatccatgtgatggacaacataatttgtgtggcacagaatcaacttctggatcacttgtacaaaacattcactccagaaaaattgggggtgagcatggttctcagcaactgcagccccaggatcatcttgactctttagatggtttccagaagcatgacattgattattctcttttaaaaacatctcaagtatcgccaaagatacagtgcgccgctgagatcttatgtgatatgagaaggagcactgaatcatggattggccaaggatacagcaatgggacaattaagtggccaaaatcaccacctgaaaaggcgatgaaagcccggaagccctcatcccagtttggtacaactgagagctcgtcaggttctcgtaacaatgaggcaacttggaatgggagcagtcactctaccaagaaaattgttgacaggaacaatgattctgcacgcttgaataaccctggtaagggaactataagatggcctgtccctgttgaagacaatgcttctcctgtcaggtccgagcggggtcttatggtcgacatgaggcagccccatggaaatggcggaaggcatctggtccaggtgtcatcacagacacggcttgagaaggagtatgagaaccagcagaagttgaggaaggcaacactgacctcttctctaggatctgcaggagattggaatagggagaagaacaggagaatgtga

SEQ ID NO: 174 - DNA, 2034 bp, Zea mays
atggatgcggtggagctgccgttaccagccaaggtggagttcgggaagatcctggcgccggcagctgctgtggagggggtggatggggccgtcgtcggtggtggccccggaggtgggagcggggaggtgctcaggagctgcgccgacgcggatcagcgtcacggtggtgatgtgaagcagcacaaccagaatgcagaaggctttccgtcttatagaagtaaaaggacgcctttggaagtctctatacagaaatctcttggttttggtttgaagtccgaaaatggtaaacgggattatgttgcgaatgatatggttcaatccttgcataagcaagatagtaagatggtcacaaaaaagaccataaagttgttggatgctccaccttattcaaaaaggctaaagcttgagccagtacaaactggtagagatgctgagattaagggacatgaattcatatcacagaagaatgtgcctgatttggcaccatgtgcaacatctgaaaaatctcggttgctcaagcagaagcgcatttctgatgcaaagagaattgataagaagaatattaggtccggtgtcagatcaaaatacgattgtttctcatcaaaagctggtttagcacatttttgttctggtttctcaggaaacagcgtacttggagcgcatggccttaaatctgatgttcgtgacatcacgaatcacattgagaacctctcattgagtgaacttcttgatggcacctacaagtattccagcttaggaagagataaaggaaagaaggtattgcgcacgaaagaggaactcctagtctctgttagaaaagctttttctatgctttctgacatggactattgccacggaaaggactctaatctcattctgggtccgaaacctcctcctgcatgcacctctagctgtgatatcaaggagcaatgttgtgacaagccatcccccttggttaaggactcgtcacaaatcaatgtctgtgatactgcactttgtcatccaaaagatatcttaagccgattaacacttcctcatcaacaagatctggactctcttttaacacctggaagtgagagcacagctgcagttaagccagttcgtggagctagtttaccaccatttccttggtcacactcacaggctgggggctgtcgacaaagtgttgactgtggtaaacatgggtcaagtagaagttactcccagtggcaatgggtgcgggttggatccaacctcacttctctagattatgaagatacgtctgtccatagaattgatcatctccttcaagagatggatgcagcaaaattatgtagaatggattcatgtgatgggcaatataatttgtgtggcacggaatcaacatctggatcacttgcacaaaacattcaatccagaaaaaatgggggtgagcatggttctcagcaactgcaaaccctggatcgtgttgactctttagatggcttccagaagcatgacagtgaacattctcttttaaaaacttctcaagtatcgccaaagatacagcatgccgctgaaatcttatgtgatatgagaagaagcattgaatcgttgagtggccagggatacagcaatggggtgattaagtggccaaaatcaccatccgaaaaggtgatgaaagcacggaagccctcatcccagtttggtataactgagagctcatcaggttctcgtaacaacgatgcaacttggaacggtagcagtcactctaccaagaaattttgtgacaggaagaatgattctgcatgcttgaattaccctggtaaggaaactataaggtggcctgtgcctgtggaaggtggcgcttctcctgtcaggtcgtccgagcgcggtcctatgctcgatatgaggcagccccatggaaatggtggaagacatcctgttcaggtgccatcacaggtggcacggcttgaaaaggagtatgagaaccagcagaagttgaggaaagcaacactgacctcgtctctagggcctccgggagattggagtagggagaggaacaggagggtgtga

SEQ ID NO: 175 - DNA, 513 bp, Zea mays
atgtcgtctgctgcgggccgcgcgccggcgccgacgccgatgggctccgccgatcgctgtaaggtacatccatcggctctcgtctccgctctctcttcctctcctttgctccgagctctgtcatcccggtctgcttcctgcgacccgccgttgcagatcgacgggatcgtggcggcggagaaagccaccaggagctgcgtcgaatgccgcgccaccaccacgcccatgtggcgcagcggcccgaccgggcccaggtcactttgcaacgcctgtgggatccggtaccgaaaaaagaggaggcaagagcttggcctagaccgcaagctgcagcaacaacaaaataatggcgaggcgaagacggatgaagcaaaagacagctctagcaacagcagcagcgggagcagcaacttgcaggtggtgcagaaacggaggctgctaatgggagtggaggaggctgctctgctgctgatgaccctatcttcttcgcccacatccacgttgcttcatggataa

SEQ ID NO: 176 - DNA, 2256 bp, Zea mays
atggacacggcgtttctgagtcctccgcttgcccgtaatctggtttatgacgagtttgccgttcttcaccccactagctacccttttcatactcttcggtatttgagatgcaatccaatgtattcgagaccgctgctaacaatagcaccagcctcaccatcaaggggcttgattcagagagtggccgcactacctgatgttgatgatttcttctgggagaaggatcctactccaatacttgacacaattgatgcacccattcatttgaaaaatctatctagtaaggagctcaagcagttagccgatgaagttcgttcagaaatagctttcataatgtccagaaaatgccaaccgtgtggtgctgatcgctcagttgtggagctgacaattgctatacattatgtgttcaatgccccaatggataagatactatgggatgctggtcaacatgtaagacatctctctgttactgttgttttgtttttctcagatctgttatctgcaacccttttccgctcaatagttttcttgcaacaggcatatgcgcacaagattctcacaggaaggcgctctctcttccatactattacacagaaaaatggcctttctgggttcacgtcgcgttttgagagcgagtatgatccctttggtgctggacatggatgcaatagtctatccgctggccttgggatggcggttgcaagggatataaatgggagaaaaaatcgaatagtgacagttataagtaattggacaaccatggctggccaggtgtacgaggcaatgggtcatgctggcttcctcgattccaacatggtggttattctaaatgatagctgtcataccttgcttcctaaagcagatggcggggcaaagatgtcagtcaatgccttttctagtgctctaagcaagattcaatccagcaaaggatttaggaggtttagagaggctgctaagggacttgccaaatggtttggcaaaggaatgcacgaatttgctgccaaagttgatgagtatgctcgtggtatgataggtcctcatggtgcaactctttttgaagaacttggattatattatattggtcctattgatggacgtaacattgatgatctcatctgtgtacttaaggaagttgcgagcttagattcaactggcccagtacttgtacatgtaattactgggactgaaaatgacactggtggaattattggaagtgaaataaatgcagttgaggaagggccttcaaactcaagccctgatcttctaaagtttttaggaactggactttctaggacatataatgactgctttgtagaagcactaacagcagaagcagagaatgacaagcgcattgtggtagttcatggcggcatgggaatcgatcgatcactccgcttattccagtccaggttcccagacagattttttgacttgggcatcgctgagcaacatgctgttaccttttctgctggtttggcatgcggaggtctaaagcctttctgcataattccatccacatttcttcagcgagcatatgatcagataattgaagatgtggacatgcaaaagataccagttcgatttgctatcacaaatgctggtctggtaggatctgagggtccaactaattcaggaccatttgatattacattcatgtcatgcttgccaaacatgattgtcatgtcaccatctaatgaggatgaacttattgacatggtggcaacagctgcaatgattgaggacagacctatttgcttccgctatcctaggggtgccattgttgggactagtggaagtgtaacatatgggaatccatttgagattggtaaaggagagattcttgtcgagggaaaagagatagcttttcttggctatggcgaggtggtccagagatgcttgattgctcgatctcttttatccaactttggcattcaggcgacagttgcaaatgcgaggttttgcaagccgcttgacatcgacctaatcagaacgctgtgccagcagcatagttttcttatcacagtggaagaaggaacggttggtggctttggatcacatgtctcacagtttatttctctcgatggtctacttgacggtcgaacaaagtggcgacccattgtgctgccagacaggtacattgagcatgcatcgctcgcagagcaacttgacctggctggcctaactgctcatcacatagctgcaactgcattgaccctcctagggcgtcatcgtgatgcccttctgttgatgaagtag

SEQ ID NO: 177 - DNA, 477 bp, Zea mays
atgatagtgccaccatcgctcatccaaaaaatgtatagagttctcacccttggaggacaagggcgaggggctggagaggatgccccccctgacagcagggcaggagaggaatttgggaattatgtctctttgaggggaatcaagggacttgcttttacttgtctgggctccatgtctaagtgggagccagtcacgtttcaggaatctcttagctttgttaagaaagtaaaggcacgtgactacatgctatacatatcattgctcgatgtgctcaaccggaatgatcaaatccctctgcaagcttacagcgagctctcgcttctgtttcagcatcacgaagatctgttagcggagctgtcgaagttcaggcccctcccatgcccaaacaacgtttatacacacggctcgatttggatgatcatattcctcatgccttttctgctcctgagccttgtcctcgccttgagaagccattga

SEQ ID NO: 178 - DNA, 1755 bp, Zea mays
atggcagggcaagcagggaacccagtaaaccaccctataagtccccacgtgataagtggcgctttcgttcagcaatattaccacattttacacgaacaaccagatcaagtgcacaagttttaccaagattcaagtattcttggtcgaccagattccaatggaattatggcatatgtaaccactatgcgtgatattaatgaaaaaatcatgtctatggacttcaggaactgcttaacagagatagagactgcagatgcacaattatctcacaaggatggggtgctcattgttgttactggttccttgacttcggatgaaggcgttttccgtaggtttacccagtcattcttcctagcaccacaagaaagtggtggctattttgttctcactgatgtatttagatttatttcggaaaggaaaccagctgagataaatcaagttgctactcaagaaaatgaaatcagtcagaatgttagacctgcatctgaaacatgttcagcactaccagaacctattccagctgatgggagtgtgatctcagaccatgtgacagctgatagtaatgtcacggagaagcaaataagtgatctttctgctaatgggactgccattgaaagtaatgataatacccagccacctgtgcaagtgcccaaagaggatccaaagaaggccctacttgttgctcctccccctccaactcagatggatgttactaagaaatcttatgcatccattgtcaaggtcatgaaggagggcccaccaactccagttgtcaaaacaacatcgtcagtttccaaacagaagccagctcctaaaccagtgtccacggctgtcgaaggcctagagaaaccatctgagaaacctacccaggctattggaaccggtgatgggattgttgcccaaaacaactcttctcgcaatgagcaaggctattcaattttcatcaagaatttgcctttccatgccaatattgaaatggttgaggaggaatttaagaaatttggtactataaagccaggtggtgttcaagtccggcacaataaggttgatcgatttggttttggttttgttgagtacgagtcccagcagtctatgcaagcagcaattgaggcatctccgattcgtatggcggacaaagaagtcggcattgaggcgaaaagagccaattcacgaggtggccgtttccaatctggcaggggagtgtaccatggtgataactttagagggcgaggaagtggctatgtggacaacacaaactacagaagcagcggcagcttcaaccgccagaatgaaggggagatgtacaaccgcaggaatgaaggggagatgtacaaccgcaggaatgaaggggacttctacaaccacaggaatgagggggagttctacaaccgacggaatgatggtggcgagaactacaaccggcgcaacgatggtggcgagaactataaccggcgcaatgatggtggcaagaacttcagccgcaggaatgacagtggtaccgagaacttcaaccgcaggaatgacggtggcggcgagaacttcagccgcaggaacgatggtgttggcgagaacttcaacgtcaggaatgacggcgttggtgagaacttcaacaggaggaacaacttcagaaatcagaatgacttccctggacgaggacggggttcacctacaccagggaacagttactaccagaacgggaatgggaggttcagtcgcgtgaacaatggcgccaagcaagctcctgtggccgcgtag

SEQ ID NO: 179 - DNA, 1617 bp, Zea mays
atgctgcatcaggagaacagtgagccgttcgtgaggcaccactctgagcagcttgcgtgtggcaacatgaggggagcagataatggtcgtccgaatttccttcctgagaagtgccagattgcagtttgtcctgaagtttgccagaggggtgaaaaagttagcctatttgatgaagggctgatacatggtgttgatctaaccaatcatattgctcagtcacaattggtgccaagtggtgtcaaggaaacaccaatagtggatcaaaacaagagacctgcatccagtgacatgcttgacatagttgaatgcaaacgtctgaagcaggaaggtcaaatcgtaactaaggaagacaaccatacatctgcagaggattttcatgagtaccccacatacacgacttgcagaagaagctttgactcaccactatctgagagcgaggatagtgaagatgaaggtgtagattcacctctccatttttcacatgctcacacctatgttgaagatgatctatggcctgccagctttcatcatgctctgggcccttttcccttgaggaaacctgttcctatcgggccaaatcatcaggctgaattacctgagtgcaggccattttgtggaagaactgaagaaggcgaaagtgtcaagtggatcagaaacggtgttgtgccaatgcctgatactggtgcatcgtctttggtgttggaacctgttcactgcaaggcagactgtgagtgtcatgatgaaggttcaatcatttgtgtgaaaaagcatgtgagggaagcaagagaaaagctgaagggttctgttggtgcagacaccttcagggagttgggtttgaatgatatgggtgaagaggttggctcaaggtggacagaagaggaggaacatttgttccagcaggttgtcttgtcaaaccctgcttctctgtgcagaaacttttgggatgaactccctcttgccttcccttccaagtccagcaaagaactagtgagctactacttcaatgtattcatgttgaggaagagggctgagcagaacagatttgacccagtgaacatcgacagtgatgatgacgaatggcaggcaggtgacgatggtgagtatccaatcacaggaagaactgatgaatacttgccaactgagtctcttactgatcaagatgatgttgcatgcaatccagttcctttagaaagggatctctatgaagattctgatgatgaggatgagctggacaatgccagtggagacaggcataatggtgcccagagggctggtatgttgtcagagggtaatcgtgtaatgtcggtcatagaacataatcaacagacgttcaagttagatgcagaggcgcaagacgactcttgcacatcatttgaggctcatcaggttggtgttgaaggtgggacacatactgatattgctgatgacaatcattacaggagtgacggctttggtggtggtgcagaacatgggttcttcggtaatcagtgtgacacaaaagagtgggacttcggtctcagtatcggttgggaaaagcatgattttttgtcaacaaacaatgtcatagaagaggtgttcgggaagtgctgtgacactgctgaccaggaccttatctga

SEQ ID NO: 180 - DNA, 2424 bp, Zea mays
atggcgagccaaggcgagccgtcttcctccgatccgaaggggaagaaggattactcgacggcgatcctggagaggaagaagtcgccgaaccggctggtggtcgacgaggccaccaatgatgacaactccgtcgtcgctctgcacccggacaccatggagaggctccagctctttcgcggtgacacggtcctgctcaagggtaagaagagaaaggacactatctgcattgtgctcgcagacgagacgtgtgaggagccaaaggtccggatgaacaaggtcgtcaggaagaacttgagggttcggcttagtgatgtggtatctgtccatcaatgcccagatgtcaaatacgggaagcgtgtgcacatacttccaattgatgacaccattgaaggcatcactggcaacttatttgatgcctttctgaaaccatactttcttgaagcctatcgtcctttgaggaaaggagaccttttcctagtcaggggtggcatgagaagtgtagaattcaaagtcatagagactgatcctgcagagtattgtattgttgcaccagatacagaaatattctgtgagggtgagcctattaagagggaggatgaggaaagactcgatgaagttggctatgatgatgttggtggagttagaaagcagatggcccaaatcagagaactggttgaacttcccctgcgtcacccccagcttttcaagtctattggtgtgaagccaccaaagggcatattgctgtatgggcctcctggctctggcaagacccttattgctagagctgtagctaatgagacaggtgctttcttctttttgatcaatggaccagaaatcatgtcaaagctagcaggagaaagtgaaagcaacctcagaaaggcatttgaagaagctgagaaaaatgcaccttcaatcatttttattgatgagatagattccatagcacccaagagagaaaagacccatggagaagttgaaaggcgtattgtttcacagctcttgactcttatggatggcctcaagtctcgtgcacatgttattgttatgggtgccacaaaccgtccaaacagtatcgatcctgctcttagaaggtttggtcggtttgatcgtgagattgatatcggtgttccagatgaagttgggcgccttgaggttcttcggattcacacgaaaaacatgaagcttgctgaagatgttgacttggagatcattgcgaaggatactcatggttatgttggtgctgatcttgctgccctttgtactgaagctgctcttcaatgcattcgtgagaagatggatattatagatcttgaggatgagacaatagatgcggagatactgaactctatggctgtctcaaatgatcatttcaagactgcacttgggacaagcaacccatctgctctgcgtgaaactgttgttgaagtgccaaatgtctcttgggaagatattggtggcctggaaaatgttaagagggagctacaggagactgttcaatatccagtggagcatccagagaaatttgaaaagtttggcatgtctccttcaaagggtgttttgttttatggccctcctggctgtggcaagactttgttggccaaggcaattgccaatgaatgccaagctaacttcattagtgtgaagggtcctgaactgcttaccatgtggtttggtgagagtgaggccaatgtccgtgagatttttgacaaggctaggcagtctgctccatgtgtcctcttttttgatgagctcgactccattgctactcagagaggaagcagtgttggtgacgccggtggtgctgctgatagggtgttgaaccagctgcttactgagatggatggcatgaatgccaagaagacggtttttattatcggtgcaactaacagaccggacatcattgacccagccttgctgaggcctgggcgtcttgatcagcttatctatattcctctgcccgatgagcagtccaggcttcagatcttcaaagcctgtctcaggaagtctcctgtggccaaggatgttgacttgaatgctctcgccaaatacacccagggtttcagcggtgcagatatcacagagatctgccagcgcgcgtgcaagtatgccatcagggagaacatcgagaaggatatcgagagggagaggcgcagcaaagacaaccccgaggctatggaggaagacgaggtagacgacatcgctgagatcaaggctgctcacttcgaggagtccatgaagtacgcccgtcgcagcgtgagtgacgccgacatccgcaagtaccaggccttcgcccagacactccagcagtcccgcgggtttggcagcgagttccggttccccgaccaaccgacggcagctgctgctgcggccgatcccttcgcatccgctgcagcagcagctgacgatgatgacttatacagttaa

SEQ ID NO: 181 - DNA, 180 bp, Zea mays
atgaggcctcaaaattttattagagaactggatcttacaaatttagcagaagactatccgaagttgagagaactcatacaaaggaaagatgaagttgttgctaagtcagcttcaccgccaatgtattacaagtgtgacctacgaaaacatgtttacaattatatttttgaatcaacatga

SEQ ID NO: 182 - DNA, 3480 bp, Zea mays
atggtcgcggaggcggcgccgtcctcctcggcggcgatctggtcgctccgccgcgacgagatcactttcgaccgcctccacaagttttggagtgccctgtcatctcgtgcacggtacgaactgctaagacttgataaacagacccttattgagcatgctcgcaagaatttgtactgttcaaggtgcaacgggctgcttttggaaagtttcacacaaataatgatgtatgggaagtcactgcatcatgaaggttcgtgtgagccaaggattcaggaagttgaagcagaagttcaggacccttcagttcatccttggggaggcctttcgacaacaaaggatggcatcctaactcttcttgattgcttcataaatgcaaaatcacttcatgagatccagaatgtatttgacaatgcacgtgctagagaacgtgaacgtgaaatgctttaccctgatgcatgtggtggcggtggcagaggatggattagtccagtgatgcctaactatggcaggggccatggaacacgagatacttgtgctttgcatactgcacatctttcttgtgacactctagtggatttttggtcggcactgggtgatgaaactagatcatcacttttaaggatgaaggaagaggacttcattgaaagactcatgcacaggttcgacagcaaaagattctgcagagactgcagaaggaatgttattcgtgaattcaaggaactcaaggaactaaagcgcatgcgaagggaacctcgctgcactagttggttttgtgttgcagataccacatttaactgtgaggtgtttgaggatgctattcttgttgattggcatcaatccttattggagcaagatggaatttaccatcatttcgagtgggctattggaacggatgaaggaaaatctgatattctaaactttgaaaatgtgggcatgattgggcaagtccacaggaaaggccttgatcttgatcagtttgaagactattttgttacactgagagcatgtaggctggatggccgccgtacagaattctgtgtgaaggcccatgccttgaagggccaatcttgtgttcaccggaggctaatcgtgggggatggatttgtgacaattacaaaaggtgaaagtattagaagtttctttgagcatgctgaagaagctgaggaagaggatgaagatgatgtagtggacagagacagcaatgaccctgatggtgatatcgctcatccacaaaagcatgctaagagccctgaacttgcaagagaatttcttctggatgctgctgcagtgatcttcaaagaacaggtcgagaaggctttcagagaaggtacagcgcggcaaaatgcacatagtgtttttgtgtcccttgctctaaaactgttagaagaacgagttcatgttgcttgcaaggaaataattacattggaaaaacagaccaagctacttgaggaagaagagaaagaaaaacgtgaagaagaagagcgcagggataggaggagaacaaaagaaagagaaaagaagaatagaagaaaagagaggctgaaaggaaaagacaaagataaagaaaaaatattggttcggtcaaaaaaaccaggtctttcaacattttctccgagcagccaagcagcaccaagtagtaatgagtctcaggatgttctagacttgagatattcagatagcgaagaggaagacaatgttgtggtcagggaacactatcctgattcttcagctgatcaatcttcaagcaaggatactgatgaacgaagcaatgagcatgaatgcagtgcaacagcagaatttgttccctcagattgtgatggctcattcttatgtgatgagtctaattcatcaagaaacttgagatttagatgggacttcccagaaaaagatgtcagttattggtatgaagattgtcgtgttgattctggagatactcaattgcagtctagggagaggatcagaaataacactagaagttacaacactgtatttaatacaaataaccgaacaagagacaagtacaacccctgcagctgtggccatcaagaagacttcagatatttttccacagcaactagatcaagtagggagacaaagatttccaggaaaacagtggctgagaaacccaggttgcaataccgcaggtgctatcctccagaaagcttcgctgtgtcaaatggacgtgttggtggtacaccaaacaagaacacaggtccaaagcaagtatgggagccaatggatgcaagaaagaagatagggaatgggagaggatcagaaataacaccagaaactactggtgctgctgatggttcagatcaagtggaatgctcaaaggacattagtgaatgtgagaagcttgaggtagtgtgtgaaacacttgctgaaacttgttgtgagatatctgcagaagcctgtaagtcagatcaaccatgtagacaaggtgagaaaaatcagtctgcttgcagcgatggatctaaatgcgtagataagccaaattgctgcttgacaaaggacactgttaggacaacaaatttaaccagttcagacagcttttcgtgtctaagtgagggagatagagacagcagcatgagtagcatgacctcactgagtgctcagaatgtagaatcttcatctacatctgattcagatgagtattcagacaggaacgatagcagcccaggcgatccaccagtgaagaatgtttctcgttcattacttgagatgtgtgcaggaaatggtttcagggagtaccaaccgaaaggcttgaaccctcctaatggcaaccaatttggatttatggtggcacctttacaggaccagatgttgcaccaacagaagatccatgcaccgccgtactcgtcaccatttgtggggttccacaatcaccccttggcagttccaacaaatgggtacttgccatatcctcagccaggtcacttctaccctggccttatgacccctgttggatgtggagtcgctggcagccaatgcgttgactttccaatgcagtacagcaataacattcatccttactcgggccccgaatttggttttctgcctgcaaaaccagttcacaagaccccagtgagcttccatgctgtgccagtgccaccactggccccgctgtgtagaagcgaggtgccagtggtgataaatcaagagaggcagcagggctctgcaccccctaaattcaaacaggcagtgctggtccctgagaacggctgttcagcagaagacaacaccttcaaacagaaaggtgatgacacagacagcacacccttctccttgttccagttcaacctgcctattgcccctcccaccctggcaacatccaaagaagagcaaagtggagcgatgccgtcaatggcactgccaccagctcagataactcgagcccagctgtgctccagggaggagaccaatgtcaaggagtacaaccttttctctgggtgtaacggagtgatgtttcagctcaactag

SEQ ID NO: 183 - DNA, 1005 bp, Zea mays
atgggagaggcctcgccgtcgatcgccaaggacgtcaccgagttgatcgggaacacgccgctggtgtacctcaacaaggtgaccgatgggtgcgtcggccgcgtcgccgccaagctcgagtccatggagccctgctccagcgtcaaggataggattggctacagcatgatcacggacgcagaggagaaagggctgattactccaggcgtgagtgttctgattgaaccaactagcggcaacacaggcattggactggcctttatggctgctgccaagggctacaaacttacactcacaatgcctgcctccatgagcatggagaggaggatcatattgaaggcttttggtgctgaacttgtccttactgacccactcttgggaatgaaaggagctgtcaagaaagcggaagagatacaagcaaagacacccaactcgtacattcttcaacaatttgaaaatccagctaacccaaagattcactatgagactactgggcctgaaatctggaaagctacagcaggaaaaattgatggccttgtatctggtatcgggacaggaggtaccatcaccggtactgggcgatacctcagagagcaaaatcctaatgtcaagctctatggtgtggagccagtggagagtgctgttttgaatggtggaaaacctggaccacacaagattcaaggaattggagctggttttatccctggagtcttggatgttgatctccttgatgaaactctacaggtttcaagtgatgaagctatcgagactgccaaggctcttgctctgaaagaagggttgttggttggaatctcttctggtgcagctgcagctgcggcagttaggcttgctaagaggccagaaaacgccggaaagctatttgttacgtttggggtgggtggggggcaaactcagtggtttcgtcaacgcaacatcattggtgcagcgcttctcagtgatggttttagtgaatttttgagtcctgaattgggctgtgacttctga

SEQ ID NO: 184 - DNA, 2112 bp, Zea mays
atgccagtcatattccatttagcaatgccgccattacgagcggctcctagatttctcacccagttcctccctatatggctatatatatacacacacacattcacgcatccctcatctgcctgtctgtctggtggtctcaaaacctgcatcaggagcctctgtgcctgctgcatgggccctccgcggccggcctcgccggcctgtgccaccgccggcgtcacggtcaaggtcagcgacagatacgtcgagatcaaaaacggcatctttgacctgacgctgtccaacccggacgggatcgtcaccggcgtgcgctacaacggcgtggacaatctcatggagattctcaacaaggaagacaaccgagggtactgggaccttgtttggaacccaccaggacagaaaactggcatctttgatgtgatcaaaggcaccgaattccgcatcgtttaccaagatgagaaccaggctgaggtatccttcaccagaaattgggatccttcccttgaaggaaaagctgtccccttgaacatcgataagaggttcatcgttctccgtggctcatccgggttctacacctatggtatctatgagcataaggaaggatggcctgatttcggcttgggagagacgagggtggctttcaagctgcggaaagacatgtttcattacatggcattggctgacgacaggcagagaattatgccaatgcccgatgaccggttgcctcctcgaggacagccattagcataccctgaggctgtgctccttgtggacccaatcaaccctgaacttagaggggaggttgacgacaagtaccagtactcttgcgaagaccagtacaacaatgtccatggttggatgtcattcgatcctccaattggcttctggcagatcactccaagtgatgagttcaggacaggaggacctctgaagcaaaacttgacttctcatgttggccctactatgctggctatgtttcttagtgcacattatgcaggagatgacctctcaccaaagttcacgaatggagagtactggaaaaaggtccatggaccggtattcatgtatcttaattccagttgggatgcaagtgacccaactatgctatgggaagatgcaaaagttcagatgatgattgagaaaggaaactggccgtactgttttgcactttcagaggattttcagaagacagagcaaaggggttgtgtctctggtagattactagtccgagacaggtatatagatgatcaagacctttatgcctcaggagcctatgtaggcttggccctaccaggagaagctggatcctggcaaagagagtgcaagggataccagttctggtgtagagcagatgtagacgggagcttctacataaggaacattgtaactgggaactacaacctgtatgcttgggttccagggtttctaggggactacaagctagatgccacagtgaccatagcttcaggggatgatatttatctgggtgacctcgtgtatgagccgccaagagacgggccgacgatgtgggagattggagtacctgatcgatctgctgctgagttttatgttccggatcctaaccccaactacgtcaatagattgtacgtcaaccaccctgcagatagatttagacagtatgggctctgggaacgatacgcggaactataccctgacagtgacctggtatacacagttggccaaagtgactatagcacggattggttctatgctcaagttaacaggaaaattgatgacaacacttaccagccaacaacatggcaaatcaagttcgaccttgacagtgtcagcccaagcagcacctacaagttcagggtggctctggcgtcttctgcgctcgctgagttgcagatttccttcaacgaccaggacagggctgttcctcacttcgccaccgggctgatcggcagggacaacgccatagcaaggcacgggatccatgggctctactggctgtttaacatcgatgtggccagtgcttggcttgtgcaaggggtgaacaccatctacctgaagcagcccaggagccagagcccgtttcaggggttgatgtacgactacttgcgtttggagggaccgtgcggctgctaa

SEQ ID NO: 185 - DNA, 1518 bp, Zea mays
atgggtctgcgcgtggccgccaccgcgccagctccggccggcgtgcgcgtgctcggcaggggcgccgcgcgcgtgacgccgcgaccgtgggcggctgtcggcggcaggagacgcttctccgtgcggatgtccgtcgcgaccaccgaggccaccaccaccatcgccgtgggcgcctcggaggaccaggcgctggaggctaggaactccaagacggtggtggcggtcatcctcggcggtggcgccgggaccaggctcttcccgcttaccagacgcagggccaagcccgcggtgccaattggcggcgcgtacaggctcatcgacgtgccgatgagcaactgcataaacagcgggatcaacaaggtctacatcctcacgcagttcaactcgcaatccctcaatcgccacctctccagagcctacgatttcagcaatggcgtggccatcggagacggattcgtcgaggttctagcagcaacccagaggcctggaacggaggggaaaaggtggtttcagggtactgctgatgcagttcggcagttcgactggcttttcgatgatgcaaaatctaaagacattgaagatgtgctgattctttctggtgaccatctctaccgtatggactacatggactttgttcagagtcatcggcaaagaggtgcaggcatcagcatctgttgtttgccaattgatggcagccgggcatctgattttggcctaatgaagatagacgacactggaagggtaatttcattcagtgagaaaccaaaaggagacgaattaaaggcaatgcaagttgacaccacagtgcttggcttatcaaaggaggaagcagaaaacaaaccttatatagcttcaatggggatctatatttttaagaaagacatactcctaaaccttctaagatggcgttttcccactgcaaatgattttggttctgaaataattcctgcttcagcaaaagaaatcgatgtaaaggcttatcttttcaatgattactgggaagatattggaactattaagtccttctttgaggcaaaccttgctcttgctgaacagcctccaaggttcagtttctacgatgctgacaaaccaatgtatacatcacggagaaacctaccaccatctatggtcaacaatagtaagatcactgattcaatcatttcccacggatgtttcttggataactgcaggatagaacatagtgttgttggagttcgttctcggataggctccaatgtgcacctcaaggatactgtaatgcttggcgctgattattatgaaactgccgtggaaagaggagagctgcttgcagaaggaaaagttcctattgggattggagagaatacaacgattcaaaagtgtatcatagacaagaatgcgaggatagggaagaaagtggtaatctccaactctgaaggtgtagatgaagctgatagaacttccgaaggcttctacattcgatctggcatcactgtcgtactgaagaacgcgataattgctgatggattggtcatatga

SEQ ID NO: 186 - DNA, 609 bp, Zea mays
atggtgagctcctcgtcgccggtggtcaacgtgtacccgctcgccaactacacgttcggcaccaaggagcccaagatggagaaggacacctccgtcgccgaccgcctcgcccgtatgaaggtcaactacatgaaagaaggaatgcgtacaagtgttgaagcaatcctattggtgcaagagcacaaccatcctcacatactgctcctgcaaatcggtaatacattctgcaaacttcctggtggacggttgaagcctggagaaaatgaaatcgagggtttgaaaagaaagttatgcagcaaacttgctgtgaactcgccttcctttccacctaactggcaggttggagagtgcgttgctgtgtggtggaggccgaactttgagactgtgatgtatccttactgtcctccacatatcactaagcccaaggagtgcaagaaacttttcattgttcacctatccgaaagagagtattttgctgttccaaggaatctgaaactgcttgctgttccactgtttgaactctacgacaatgttcagaggtacgggcctgtcatctctaccatcccgcagcagctttctaggttccagttcaacatggttagctcttag

SEQ ID NO: 187 - DNA, 3579 bp, Zea mays
atggaggcggccgcctccagcctctcgacgctgctttccaccttgcgcgtgaacgggccctggacgccgccgggaacctgggagtcagtcatacctgagagcggtgctgctcgcgtctctcaccttggaggacgccctcgcctgcagccgatctacgagctcgcatcggttactgatgatgctttgattcatctggccttgcatgcgctgtatggtgtcaaaacatcgttagatgagattgaggagctttcagcactgtcttcctcaaatccggctgacaggacctctaaccgtgtcccaaatgtgtggttacgttcctcgagcaccacatccatggggagtattctcaaatctttccgctcgacaggtcttgcggtcttcttcctttgcaagtttgtgcacttttatcttttccaaagtcgagaaatgaactgtgcaagtagagaagttcacgaacatgaagattctggagataaagacactaagcagcatcagccttacactctagtaaaccaagcatttgcagcagcagttaataaggtcctcgaaggctatttctgttcattgaatactttactagcatcaattaggcttaggcgttcagtgggccaatctggtatagcttccaagatttcaaatggaatgagttgtgatcccacttcagaggtcactcttctggaagtttatctacacaccgaggagttaagaaggcatgttaaatcccttggaaatatttgtttccctaagtttgcaggtcttacattgtgccaggagggtttgaatactgatgcaaatgtggagtttgagaatttcccacggggcaccgatttgctttcctatttgtatgtccatattcgtgatgctgatccagttcactatggtcttttgaagtatcttttcattcgttcctgtgagccatactttaacttcattaagtcatggatttaccgagcttctgttgatgacccttatgaggaatttctcattacacaaactgaaaataagggtgctcaaggaatctcttcagacataacagatgatttcatcctcttccccttaaagggaagaaaccatgtatctgctccatgttttctaaaggagatatgtcatcctcttttgcgtactgggcagcagcttcaagtgctcatgaaccttctaaagtattgcaatctggctgctactgaaggagatgtttatccctctcgtaatatcattcatatggagggggttctcccgtggtttgatacaccaattgagtcttcaatgaattcatttacattttcaaaaagtgctatagaggcattaacatgcaaaagggatgctatgtacaagttgatgatggagaagctccaacattttttctctaatgttgaggtgattgcttttgatactgcatcaaatttcctacataaaaggaccgaccttgtagatgcatctgtttcagatgctgagttattctatggggacagcgacgctgtactaccttgcaatatggctgcagatgaaaaagatgattcttcttcgaattcccaagaatcttcagataaagaagatcccttggaatcttcagaatgttcttcttatacttctatggatgacacagaagttgagagttctacagcatgtgaaaacttgtctagttccatgttctcattatactgtacaagcacaggtgaagcaaaaggctccttggtaaccagtaagctgctttcttcccaatccagttcagttgaccatggaataaattgtgcaatccctattgagtgtgagaaagatgacaggttgagttgcaaacatgtccttgtgcacccacagaatactaagcatactgcggtgcctgatggttcagaactggattatcagtatagccagttttcaccatttgacaggtttatgaagagagccagttgctcatttgaaagcatgaattcagttggggagtttttgtattctgatcataaaaggtcagtaggtaatgcagtttatccattacattctgaatcagggagtactaaactatcaaacagtaaaaactatgaaaagtttgttactataaatcagccatggaataccagtattccttacaatctcagtttgaaccccatactgaaaaatgcagcttgttaccatacagagagtgacatgcaacagaaaagcaagaaccaatcacttgccagttttgattttgagtcagtcatggatccatgtgaagtatattgtgcaaggagcccatcccttcttgttgagtctgtaaatggagcagcaacagctggacagcccagtactcagccttatgaacagcctgattgttctaccaagcttcttcaagctcagacaagaagtcagtcatcccttacttcctcaggagaaatgtcaacaggagatagtcttcagaaaaatgcttctggtggggcattctgggagatatcattactatataatgataaatcaaaagaaaaaccagctatggactttagttcacaatttgatatgccccttgatatagttatcgataagtgcattattcaagaaattttgcttcagtataaatatgttagcagcttcacgatgaagttgcttgaggagggttttgatctttgtgcacatctactggctctgcggcggtaccatttcatggaaatagctgactgggcagactcctttattgcttcaatttatcagaagaaatggtcatttgttaaatctgagcagaaaagatcggagatccaaggacttatggacttggcattgcagagatcttcatgcgattctgatccttataaggaaagattatttatatacatgagggagtcacctgtggattctgttgatgcctctccatgtggtcttgatttgctggatgatatcttgttgggttataaagctgaatggccaatgaatattgtcattacagtagatgcactgaaaatatatgctgaaatattctgttatcttcttcaagtcaggtttgcagtgttttccctgactgaagtttggagatttttaaaggagttgacacagttcatcggtcgttccagccatagcagatctgatgtgttgaagaaattgaattttgtaatgaaattgaggcataaactttatcactttctatcaacactacagcagtatctccactgccatttatctgatatatcgtggcgccgttttcaacattcccttaaaaatcaggtgagggatatactggatctggagtatgtgcatatatgttatattactgatgcacttgacatatgtttcttatctgatgagtcaaaacaagttgctacgataatcaagagcatgctgcagctggctttggagttacgatcatgctttcagagtggtgacacttgtgatttatcagtaaatcaactcagtaatttgcaataccttataaacttctctcaggtggatgtaattagaacaaagttcgaggataacatcaaagatctctatattttgcattcgaaatcttcaaaatatacggagcttggcctttcccgtttctgggggtatctgaactacaatgagtatcattctacgaaagtcagcaaagatatggacaacttctatttttga

SEQ ID NO: 188 - DNA, 486 bp, Zea mays
atgtggcgtaaaagactgattcaacgaaatatgcctgcattaagatttaaaacgtgccgtctacttccaggaaatgttcggaacagagaactttctctaatccaacgccgcattctccgaagattgaggaacaagaggagatccattaaaagaaatctttctcagagagaaaatctaaacagtaacatcaaatcacaaactacacgaaagttgtccctttattatgggtatttacccataagggagatgcacagaggaagagaacgaacttcatatatcccttttttactcaatcaagaaacaagatcagacgtgattccggttcgtctccgttttagtgacactcttcctcaagcaaggcagccgataagtcatcgaagggtttgtttgaataatggactggtaaccattactcattttaaagtttcccatggtgatctaatatctttaaagaaaatgacgcgagaacccgcggtgaagaaataa

SEQ ID NO: 189 - DNA, 1248 bp, Zea mays
atggaggtttccaggtggaccccggcggccggcctcctgctcctgttgctcctcccgctcgcggccaccccgtcacgcgccgccacgatggcgagatcgccgtcgtcgtccactgccgtgttccagctccagggagacgtataccccaccggccactactatgtcacgatgaacattgggaacccagcgaagccctacttcctggacgtggacactggcagcgatctcacctggctgcagtgcgacgcaccctgtcggagttgcaacaaggtgccacatcccttgtatcgaccaacggcaaaccgccttgtaccgtgtgcaaacgcactctgcactgcacttcacagcggacagggctctaataacaagtgcccttcaccaaaacaatgcgactatcagataaagtacaccgacagtgcatcttctcagggtgtgctgatcaacgacagcttctcactgcccatgagatcctccaacattcgtcctggcctcacatttggctgtggatatgaccagcaagtggggaaaaatggcgctgtgcaggcagcgattgacggcatgcttgggctcgggaggggatcagttagccttgtttcacagctcaagcagcaagggatcaccaaaaatgtcgtcggccattgcctaagcacgaatggaggggggttcctcttctttggggatgatgttgtgccttcatcacgtgtaacttgggtgccgatggctcagaggacatctgggaactactactcacctggctcaggaacactgtacttcgatagacgttcactaggcgtgaagccaatggaggtggtatttgacagtggtagcacctatacttattttactgctcaaccataccaagctgttgtttctgcgctcaaaggtggtctcagcaaatcacttaaacaggtgtcagatcccactctgcctctgtgctggaaagggcagaaagcattcaaatctgtgtttgacgtcaagaatgaattcaagtcaatgtttctgagctttgccagtgccaagaatgccgccatggagatcccacctgaaaactacctcattgtcacaaaaaatggaaatgtgtgcctgggcattcttgatggaacggctgccaagctgagtttcaacgtaattggagacatcacgatgcaggatcagatggtgatctatgacaacgagaaatcgcagctgggatgggcgcgtggggcatgcactaggagcgccaagtctattctgtcttcctttccctga

SEQ ID NO: 190 - DNA, 5034 bp, Zea mays
atgggcactggcggctggcgcagaggtagcaatgggctggagcaatgggctgaagcaatggagcggcggcggctggagcactgggcagccacacttgcggcggcgcactgccctgttcctttggtccattattgtcaacagctcggatcaactctccacagccatgaaacatgcttcacccaaacagctgactcgctgttttatatgcacgagtgcttgcagcaggctcgggctcctatgttcgatgttccttctgctattgaagtcatgcttacagggggttatcagaggcttccaagatgcatagaagagataggaagtcaacataaactttccccagatgaagaaaagcgcgctctgcgaaaattagatgctagcgtgcggtacagagtacttgtgacaccaagacctaaagaagtatctaatgtttcagtaactgatgggatagctgttttccgtgtggatggagaatttaaaattcttcttacattaggttaccgtggtaatgtagacttatggaggatattgcatatggagttactggttggtgagaagaagggtcctattaaactggatgaaagtaggagatttgctcttggtgatgatatagaaagaagaatggcagcttctgagaatccctttgcagtgctatatgctatacttcatgaattctgcatctctcttgctatggacactattattaagcaagctaatgttcttcgacagggaaggtggaaagatgccataagatctgaactcatctctgacagtgccactgtacaaacgggaaatactcctctaatgcagcttgttcaagatgcggagttcgattcaagtggttttaagatacctggcctgaaagttaattactggctagatgagaaaagcactagcacagcagaacctgattcatctccatttattaaaattgaggcagggctggacatgcagataaagtgtcagcatagttcatttatacttgatccatttacagataaagaggcgagcctttctcttgatctaagttgcattgatgttgagcaacttattttgagagcagtttcttgcaataggcacacacgccttcttaatattcagagacaactgtgcaaaaatgtccaaatttttcagtccccaaaagatgttgtcttgacacgagatgttgcagcagcgaaggacccaatgatgaatgcggagaagggtttctcagattgttttgggaatgaagtgcttcaagtaagggcatgtggtcaggcatatgttagtcttggaataaatatcaggagtggccgctttctcctccaatcaccagaaaatatattaccccgtgctgcacttatggactgtgaggaagctctaaacaaagggagtacatcagctaccgaggttttttcaagccttaggaccaggagcattctccacctacttgctgcaactggaagtttttttggccttaaggtttaccagcagtctcagggcactctgaagattcccaagaccttattacatggctcagatttgatggtcatggggtttccacattgtgcaaatgcctattatctgttgatgcaacttgataaggacttcaggcctgtttttcatttgcttgagacacagtgtgatgcaaatggtaatactaatgcaagtggagatgtgaaagaagctattagatataacaaaatcaatataggacagatgcaaatacttaaaaatgagatgaatgagaacccttttgatgtgaagctgcaggccctacaaagtttagtggactctgctgacatgatggagagtgatcttcctgtccaaaatgcaattgaacctcttccactacttcctgcttgttcaccatcattttcatctattgttgatgaggttttcgaatatgaacgtggttctactgctgcgcagaatcgttgtcttccagttgatattcaaggaataaatgctagggttgtctcaccaatgcatgatggatgcttatcttatacccaagctaataataacatgaatgttcatcctaatgtcagtttgaatagctatttcccaagtaactttagacatttacaaggtacaaacacattttcttcaaaccctgtaatgtctatgaccaaattgtcaggttctaattctaatcatgacctgtgctcgctaagctctccatatgactatgacattgcaggtgcaaataaatcacttcagcttgtgccttcaagattagggaagctcatcactgctggttctgatggtgcatctaggaaacactatctttcagatttcttatcaagtatcccttcattacgaggactgcaacctagtgagccaagaaagcggagaaaaaaaacagaatcagtgcagagtctcctgcctttgcaggcacactcttctaatttgcaatcaagaggcagtctcacctatggagatgttcttgctgaaagaaataattgtgttccggcaactatatatgcttctgtgctactacatgtcataagacactgttcattatgcatcaaacatgcccaactcactgctcagatggattcccttgcgattccatatgttgaagaagttggtctgcggagaccatcgtctaatctttggttgagattaccttttgcacaggatgattcttggaaccatatatgcttgcgccttggtaaggctggaagcatgtcttgggatgttaggataaatgatccacatttcagggaactttgggaacttaatggaggaagcaccaaaacacaatggggtgttggcattcgcattgcgaatagctcagaaatggattcacatatctcatttgattccagtggtgttgttttaacttacaacactgttgaggcagatagtgtccagaagcttgtgtcagatttacgccgactttcaaatgctcgttcttttgctcttggaatgaggagactgattggtgtgaaatttcaagacaagctagatgacaaccagttaaccatggaggtgaaatcacaatctgttaataaaggtaacagtgatgctgctgacaagctatctgagcaaatgagaaagacattcaggattgaagctgtcggtctaatgagcttatggtttagctacggcaccatgcctatggtacacatagttgttgaatgggagattgctaaggctggttgcacaatgcacgtttctccagatcagctttggccacacacaaagtttctggaggatttcgtgaatggtggagaggtagcatccttcttggattgcattcggcttacagcaggaccattacttgcccttggaggtgcaattcgtcctgcaaggatgcctgttgctgtctcatctggatatagctctatgccaaaacagccgaacatccccacacaagggcctttagtaaatggttcatcttcaactatacatcacgcacctggcccctcaaatgctgcatctgcccatttaggcagtcataaccttcatgctgctgccatgctttcagctgttggacgcggtggacctgggcttgttcccagttcattactgccttttgatgtttcggttgtacttcgtgggccatactggatacgcattatatatcgcaagaaattttctgttgacatgcgctgctttgctggggatcaggtttggctccagccagctactcctcctaaaggtggaccttcagttggtggatcgttgccatgcccacagttccggcctttcataatggaacatgttgctcagggtctaaatgctcttgaacccaacttcatgaatgctacacaggctagtggacacttaaataacaatgcaggagttccacaaactgctcctagtgcaaatcgtttaaatgctacccctggtgtttctatggtcaggccaacatctggtgttgctaaccatgtagcagccagtttgagtcgagcaggaaatgccatgttggcttcttcggctcttgcttctggtattagtggaacttctgtgcgacttactgctggagctggtctccctgttcacatgaaaggtgaactaaacacagctttcataggactgggggatgacggtggatatggtggtggctgggttcctttggcagctcttaaaaaggtgctgagagggatcctaaagtacctaggagttctatggttgtttgcacaattgcctgaacttttgaaagaaatactaggatcaatcttaaaggacaatgaaggtgctctcttgaatttggatcaagagcagcctgcactccggttctatgtcggaggatatgtatttgcagtaagtgtacatcgggttcaactgcttctacaagttttgagtgtgaaaagatttcaccaccagcaacagcagcagcaggctcaaagcaatgctcaggaagagctagcagcagttgaaatcaatgaaatatgtgactactttagcagacgtgttgcctccgaaccatatgatgcttctagagttgcttcttttatcactttgcttacattaccaattttggttctgcgcgagtttttaaagctgattacatggaagaaaggtctttccccggttcatggggacattgctactgcacagagggctcgcatcgagctttgtttggagaatcactcaggatcagcttcgtctgataacaccgagaacagcagtttagccaagagtaatattcatcatgatagagcccacagttcagtagaatttgccctgacatttgtacttgaccatgctcttattcctcacatgaatgtagctggaggagctgcctggcttccatattgtgtatctgtgaaacttcgctattcttttggggacaacaatcatatagctttccttgctatgaatgggagccatggtgggagagcctgctggttgcagtttgaggagtgggaaagatgtaagcagaaggtttcaagagctgtggaaactgtgaatgggtctggtgtagctggagaggtaggccaaggaaggctgcgaatggttgcagagatgatccaaaagcagcttcaactctgtctacaacagctaagagatgacccactttctgcaggctcgactgcatcatga

SEQ ID NO: 191 - DNA, 903 bp, Zea mays
atgcagaagaagcctgatgacgccatggaggaggaggcggcggcggctcctgggccggagatagggttctggttggcagcacggcggcgactcgccccagaagaccccttcttcgctgccggggacctcgagcgcgagctcctggccaagcaccttgccctggatctttctgaagatgaccgcaaccagcttgagaagatggaagtagccagcacgtgcacagtgttttgtccaattgctggttgtggtgctcatctagattgcctggaggagtttgaggaccactatgtcactcgacatactgcttcatgctctgtatgctcgcgagtttatccaacttcaaggttgctgagcatccatgtttctgagacgcacgactcgtatttccaagcaaaagttgcccgtggttttccaatgtacgagtgtttggtggagggttgtggtatgaaattgaagagttacaagagccggcagcagcatctcatcgataagcatcagtttcccaaatcatttgagttcttcaaaaaggcacgggactcccagcgtcagcggcagaagtcccagaggaggcagactgctcacaagggtgaagagacaagggataattcgatggacgtcgacggaaaaggtgcaaggcaaacaaaccggaggtaccggctgaagcaacatgatcatagcgaaccgaaagagaacaagcagcagcataaggaggcccaggaggacgaaatggaggtcgagcagaagattgatgagctcacctctgctgtatcgaggttgagcacagcagattctacgccctcaagcgtcacctttggccaccgtcgctctcgtggccttacgtttgttcccaggtcaatcaggcagaataagcaggcggccctcccagctggaagcaacaaatga

SEQ ID NO: 192 - DNA, 657 bp, Zea mays
atggttaagctgactatgatagcgcgtgtcactgatggccttccattgtcggagggattagatgatagtcgggatctcaaagatgctgacttctacaagcagcaagcaaaactgttgttcaagaacttgtccagagggcagcatgaggcgtcaaggatgtcaattgagacaggaccgtaccttttccactacatcattgaaggccgtgtttgctatttgactttgtgtgaccgttcttatcccaagaaacttgcattccagtatctcgaagatctcaaaaatgaatttgagaaagtcaatggcagccaaattgaaactgctgcaaggccatatgcatttattaaatttgatgcattcatacagaagaccaagaaactgtatttggataccagaacacagaggaaccttgctaagctgaacgatgagctctatgaggtgcaccagatcatgactcgcaatgttcaagaagttctcggtgttggtgaaaaactagaccaggtgagtgagatgtcaagtaggttgacttcggatactagaatctatgcagagaaggcgaaagatctcaatcgccaggcattgattcgtaaatatgcccccgttgctattgtgattgggatagtagtgatgctcttctgggtgaagaacaagatatggtga

SEQ ID NO: 193 - DNA, 2031 bp, Zea mays
atggagatgtgcagaggtgggaggaagggatcgcgggcggccgagaccttgccgatggccgccatcgcggggctcggccacggcgacgcgagtgcaggtgcgggcgccgatggagatgtgcagaggtgggaggaagggatcgcgggcggccgagaccttgccgatgtcatattcaccaacgagtcaaacattgtgcgctggaagaacaagcgacaacaagctgttgactccaaagttggccgccttgataactttattgaatgtgttaaagcccctattcaggaagtaggtgtccctaaaatccctatgatctatggaagggttggcgttattgcccttgacaatgcgcgccaaagtgctaagattattgaccaatctcttaccccaggaaagatttatgatggagatgggttcaattacatcaaagaatcttttgaaaatggtactcttcaccttattgggttgttgagtgatggtggtgtacagttaagttacaagcgtaccacaagatttacttttatttgctctatccagttacttctgaaaggtgttagtgagagaggagcaaaaaaaattcgtgtgcacaaccttaccgatgggcgtgacgttttggatggaagcagggttggtttcgtggagaccctagagaatgatcttttggagcttcgaggcaagggtattgatgcacagattgcatctggtggtggaaggatgtatgttaccatggaccgttatgagaatgactgggatgtggttaaacgtgactgggatgctcaggtgctcgaagaagcaccctacaaattcaaaagtgcacttgaggctgtgaaaacactgagagcacaacccaaggctaatgatcaatacttgcccccatttgtgatagttgatgacagcggcaaagctgttggacctgtattagatggtgatgcagttgtcactatcaacttccgagccgatcgcatggttatgcttgcgaaagcactagagtatgcagattttaacaactttgaccgtgtacctgtccccgaaattcgatatgctgggatgcttcaatatgatggtgagttgaagcttccaaatcgctaccttgtttccacaccagagataaatagaacatctggggagtacttggtgaagaatggcatccgcacctttgcttgcaggcaaccagggaagacaacgcgttcatcctcccacgcgcttcctccgccctattttagtctgctcgacacgccaccggccactgacatcccatatcgccaagtccccttccctcgcctcgcgttagtagcctgcttccgacccgcacatctccctccggttctcgccatgggcgccggcgccaacaaccacgaggagtcgagccccctcatcccagctgcggtcgccgcccccgcgtacgagaagcccccgcaggctccggcgccggaggccgccaattactatgccgacggggtcccggtcgtgatgggcgagcccgtgtcggcccacgccttcggcggcgtcccgcgggagagctggaactccgggatcctctcctgcctcggccgcaacgacgagttctgcagcagcgacgtcgaagtgtgtcttcttggaacggtagcaccatgtgtgctctatggtagcaatgttgagaggcttgctgctggacaaggcacatttgcaaacagctgtttgccttacactgggctgtatttgcttgggaactctctctttgggtggaactgccttgccccatggttctctcatcccactcgtactgctattcgacaacgctacaatcttgagggtagctttgaggctttcaccaggcaatgtgggtgctgcggcgatctggtcgaggacgaggagaggcgtgagcacctagaggccgcctgtgaccttgcgacccactacctctgccacccctgcgccctctgccaggagggtcgcgagctgcgccgcagggttccccaccctggattcaacaatgggcactccgtctttgtcatgatgccgcccatggagcagaccatggggcgtggcatgtga

SEQ ID NO: 194 - DNA, 1950 bp, Zea mays
atggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcaggaggttcagtgatgcgtctgtccagagtgatatcaagttgtggcccttcaaggtcatttctgggcctggtgagaagccaatgattgttgtccagcacaagggtgaggagaagcagtttgcagctgaagagatctcctctatggttcttatcaagatgcgtgagattgctgaagcttaccttggtagcacgatcaagaatgctgtggtcacagtccctgcctacttcaatgactcacagaggcaggccacaaaggatgctggggtgattgctggccttaatgtgctgcgtatcatcaacgagccaacagctgcagctatcgcctatggtcttgacaagaaggctaccagtgtcggtgagaagaatgtcctcatctttgatcttggaggtggtacctttgatgtctccctcctcaccattgaggaaggaatctttgaggtcaaggccacagctggtgacacccatcttggtggtgaggactttgacaacaggatggtcaaccacttcgtccaggagttcaagaggaagaacaagaaggatatcactggcaaccccagggctctccggaggctgaggaccgcttgtgagagggcgaagaggactctgtcttccactgcccagaccacgattgagattgactcgctgtatgagggcatcgacttctactccaccatcacccgtgccaggtttgaggagctcaacatggacctgttcaggaagtgcatggagcctgttgagaagtgcctgagggatgccaagatggacaagagcaccgtccatgacgttgtacttgttggtggctccactaggatccccagggtgcagcaactgctccaggacttcttcaacggcaaggagctgtgcaagaacatcaaccccgatgaggctgtcgcctatggtgctgctgtccaggctgccatcctgagcggtgagggcaatgagaaggtgcaggacctgcttctgctggacgtcacccctctgtccctgggtctggagactgctggaggagttatgacagtgctgatcccgaggaacaccaccatccccaccaagaaggagcaggtattctccacctactcggacaaccagcccggtgtcctgatccaggtctacgagggtgagaggacccggacacgcgacaacaacctgctgggcaagttcgagctctccggcatcccccctgcaccccgtggtgtgccacagatcaccgtgtgctttgacatcgacgccaacggcatcctgaacgtgtctgccgaggacaagacaacggggcagaagaacaagatcacaatcaccaacgacaagggccgtctctccaaggaggagatcgagaagatggttcaggacgctgagaagtacaagtctgaggatgaggagcacaagaagaaggtggaggccaagaactcgctggagaactactcctacaacatgcgcaacacgatcaaggacgagaagattgcgtccaagctgccggccgatgacaagaagaagatcgaggacgccatcgacgcggccatcagctggctggacgccaaccagctcgccgaggcggacgagttcgaggacaagatgaaggagctggagagcctctgcaaccccatcatcgccaagatgtaccagggcgcgggtgaagacatgggcggcgctggcggcatggacgaggacgcccctgccggcagcggcggccctggccccaagatcgaggaggtggactaa

SEQ ID NO: 195 - DNA, 7509 bp, Zea mays
atggatctcgcggggatgaagcggcgggagctccaggcgctctgcaagcggcacggcctccccgccgggggcaccaacgccgacctcgtcggacgtctcgacgccgtgctttcggggcccgctgttgtggaggaggaggttgccggagtgccggcgaggaaggggtgtctgaagcaaacgggcggaggtgccaccgaggccaagaaggttacttttggggcggaggtagggaaggccaggagactgaggtctcgggtcatatggtcgccggtcgttgccaagacaagggggaagtctgctcgagccggtactgattctgctgctgaagacggtatttctgcagatgtgggcgctgatgtcccagtgaggcggtccaggaggaattcgttcaatcctgccgaggctgaggaagcaggagaggctgttgctgttgacaggaagcccaagcgcaagaatcaggagaatgacgagggcgttgctgttatcgctcaggctagagttacgagaaggtcaaatttggagtggtctgctactgtattgcctcctgctgttgagaagaagagagggaggcagaatgcagctgagtctgatgtgcagaagtccgctctggtggaagtaacagctaggactacaaggtctcgctcaatcgtacctgttgtggtgccacccactgtggttgagaacaagaggaggaagactggagatccacaaacaactgtagagttgactatgctttcagatgtgcccagaagtgattttcctgccaccaggtctttaaggaacaaaattgtccacgttaacaacagcgtcgtggacgaaactcacactaccaggcagttggaaaacaagatgcgtccgtctactcgtaggcatcaacaggttgcatcttctccggaggataaaggtcaaaaaattcctgctaccagtaagtcccctctactgaggtggtcacggagaaactattctgaggccaatagtgcaaattcagtaaacatcaaattggccaaagactcgagcacagctcagccattggcacaccataattctcattctgaagatttggagaaacaaccagcagttaaagaaccaattaaacggtcaacacgtaaatctattgctttggctgcacttgagaaagagaaggatgtaattgaaggaaagaaccctgaagcacatgttaggcgatcaacgaggaaatcagttgtgcaggttaaagataccaaaagtattgttgaagagactcaatatgctaacagtgaagatgtggcgaagcaaccagcaactaaaggacctgctagggggctgagacgtaaatctgttatcacagaattgcatgagaaagagaagagtctcattgccgaaaagaacatggaaacagatgaagcgatattaacgcggaagcctgtaatcccagttaaaaatattaaagctgttggtgaaggaattcaaattggtaagggcaaagatgtggataaacaatttgttgtgaagcaacctactaggcgatcatcgcgcaaatctgtgctgcctgatatgcttgagaataatagtggacttctagcacccaaaatgaatgctgagatgaatgttaggagatcaacacggaagtctgttcttcctgacatgcataatgagaagcaagatcaccataaaatggctagaaatgagaacttgcaaagtggtaaatatcaagatggtgagaagcaacagaaagtaaaagattctattaggcaatcaaggagatctatcgctacagtgctacttgagggacaaaataatgatgaaggaaaaaagttcaaaaatcctacgaggaggacaacacacaaatctcatgcccttaatgcagttgaagaggtcagcatggatcacattgaagttggtgaagaaggcttgaaattgaggaagcgcagtaggtttttgctggaaatatcatcttcagctaatgtttcctggaagcatcagaatgcacagatctctaatgaaaaagataacacagaaggatcgcagcaggcatcaaattgcacaacttcaaagagaaggtcttcaaagaagagacgaacaactgctccagaagaagtgatgcctttcaaggtggcaaatgatgacatagttatcatggaagaaacaaaggacacacttgaatataataatgagtctagtagtaaagttcaagaaatttgtcaggttaatgctgcaagagaagagttctcttcaggtccattgcttgtaacagtagctcctagtgacgaaatttgcacagtgcagagtgtagctgtggtgatacctgggtcagaatctggtgacgatgcaaatcaaagttctgataagagtaagcaacctcaggaacattctgtcactcaaactgttgatgaccatttatctgaaacaagaagtgggaaattagatcaatcaacatgcatcacaggattagtctctgacaattgtgttgtctcagaggacaaaacattgatgagtgaaggtgagggagactttgttggtccaaaatcaccaaatggtttatcaattagtttcattgtcgcagaccgtgaagagcaaagccctgtgtccggagaacagagagttagcttggaagcaaatgccaatgagcctgaggaaaagaacctagctaacgtcacatcaactgatctccacaccaaaagtctgcagcatgatattgacagaatagctaaagagactgataaagatgttttgtctttggttttccctattgaagagcatgaagaaaaatatggagtgagccctatagctgttgaaaagtgcgtctgtcgtgaagcaagtgcatgtgaatctgcacgaaaacccctaaccgttatcttttctaacaatctccacaccaaacatctgcaacatgattgtgatgtgctaattaaggagactggtgaagaagttttagctcaggagaattgtaatgaccagcctgttcctgcccagactgaccaagaaattaagttaaacgatgaacttgctgatccggatgttttagctcaggagaattgtaatgaccagcccgttcctgcccagactgacctagaaattaagttacacgatgaacttgctgatccggaccatgaagagcaaagccctgtatccggagaacggagagttagcttggaagcaaatgccaacgagcctgaggaaaagaacctagctaacgtcatatcaattgatctccacaccaaaagtctgcagcatgataatggcagaatagctgaagagactgataaagatgttttgtcttttgttttccctattgaagagcatgaagaaaaatatgcagttagccctatagccgttgaaaagagcttccgtcaggaagcaagtgcaattgaatctgcaggaaaacccctaactgtcatcttttctaacgatctccacaccaaacatctgcaacatgattgtgatgtgctaattaaggagactggtgaagaagttttagctcaggagaattgtaatgaccagcctgttcctgcccagaccgacctagaaattaagttaaatgatgaacttgctgatccggatgttttagctcaggagaattgtaatgaccagcctgttcctgccaacgagcctgaggaaaagaacctagctaacgtcatatcaactgatctccacaccaaaactctgcagcatgataatgacagaatagctgaagagactgataaagaccatgaagagcaaagcaatgtgttcggagaacggagagttagcttggaagcaaatgccaacgagcctgaggaaaagaacctagctaacgtcatatcaactgatctccacaccaaaactctgcagcatgataatgacagaatagctgaagagactgataaagaccatgaagagcaaagcaatgtgtccggagaacggagagttagcttggaagcaaatgccaacgagcctgaggaaaagaacctagctaacgtcatatcaactgatctccacaccaaaactctgcagcatgataatgacagaatagctgaagagactgataaagatgtttcgtctttggttttccctattgaagagcatgaagaaaaatatgcagtgagccctatagctgttgaaaagagcgtcagtcgggaagccagtgcatgtgaatctgcaggaaaacccctaactgtcatcttttctaacgatctccacaccaaacatctgcaacatgattgtgatgtgctaattaaggagactggtgaagatgttttagctcaggagaattgtaatgaccagcctgttccggcccagactgacctagaaatgaagttaaacgatgaacttgctgatccggaagttttagctcaggagaattgtaatgaccagcctgttcttgctcagactgacctagaaactaagttaaacgatgaacttgctgatctggctatggaatcaggttgtagcattactgaaaggaatgaagggcttgttgctcataatcttgatcaagaaggtttccttgaagcaacaccagagtgcaaacaggaatgtggtttgcctgaggagacagtaatttcctcaaaagaaacaggatctctgctgtgtgcagatcaatcaccaattggtctggaatctttattttcgcaagaaagcatagttgaatcagtggggcattgtgcacttgcttcagcaacaactcataccgaaaatggctttgatgattcaaaagattgccataacaagtctgcacttgaaaatgttcatgtgccagaaccttgttcacacaatgatactaaaggaggcatttttaaaaatgttgattgtatgcatacatcccagcgagatgatagaatggaaggagtaccagaggctaacactgatgaagaacatgttctgtcagcctttttgctggatgcaaatcacctaaacgtagtcattaattctgaagaagtggtttgtgagggtgaagatagtaaggagcttctccattcggaagactgtaaagcttcatccgagaaaacagatgtgaatgatggcaatgtatatggtattagtgatgctgtagtgagatgtgcactgcatgctccagccgatgataattatgagatttttttgggtcccaatactgatgtaccacgtcaggtttataatgacggatgcagtgatgtcaaagaagatcgatttgcttccaaaccctggacaattgatattattgaggatgcctctgtcaaagaaagatcaaatttaaaagattggcaacttgattccaagttggagggcacagaaatagtggaatctggcctttacttcaataaggatattggtaacattttacatagtggatctattggtgaaataactccatctggttctggtttatcaaaagattcatctgtggactatagaggggaggttttagatggcttctcaatggaagcatctcttgaaaggtcttctacacgtggggaacaaaatggttgtagactagatgctattgagaatccttcaattactttagcaacttctggttataagcatgaaggtgctttatctgaggaagcagtgtacacaaagaagaattacgctggaacatgcttgtcaaatcccagggaattaatcatggagctgcaatcccatttctcaaaggaaaacataaatgaatctgatcctcatgacagccttgtattcccaactgctgaaaattcagcagatgaacagctggttaaagtacaccatggttctaatctgtctcagttaggattaactgatctgttggatggaccaattgggtgttccaataccgacgtgttgtgccagtgtgacaatcataaaaatcaatccaatgaggacaaggtagaggaagttgaggcggtgtctgctgctaaatacatagaaagtgaagttgtgctgctcccatctcaagagagatcaaatttgaataatgagcagcttaacaccaagttggaaagcccaaacattatgggatcttgccttaactgtgataacgatgtttgtaatacttcggacaatggatctgtttttgtcattggtaaaagaactccatctgcttctggcttaccagaagattatcctaaggatagtgacttgcaacaaccggttttagatagcttctcagtggtttcatcttttcaagacaatatatctgggaagaaaactgtttctggtgtagcaggcagtgagattctttctttaagtttagcaactcctgattataaacatgaagatggtttctctgaggaagcagtatgcagaacaaagaattatactggaacttcctcggtagatccgaggcatttagacatggaggggcactctatttactctgagggaggtactgaaaaatctaatctgcaagataatcttgcatttctaagcgctgagagtggaaaagatgaacctattatttgccatgttgagaaactggttgacgcacatgcttcttcagatacataccaaggtccttgtcaagatctaggcagacatgaagaacaagagagctgcatgtctattcctatgcaagccaaagaaagtggaggggttttgaggtctagccacacgaaagggtcagttacagcagcccaaattgatttggcaggtgatgcccatcttattgtgagtgataatgctgctgccaagcaagtgtttagtgaggagaaagaggaaacaaaatctatctcttcttcagatattgatatccttcatgaaaaatcatactccagtggacacgatgaccatgctgcttgtgctgccgaaactcagttctaccatccacagaaagcatctatatctgatggactacatttgggtcctagttctttgcaagtagaatcactggatgctttggatagcgatatactgtatgttaacacaggagttctcgagcagcatcataaagagggttactatgaacccagtgtctaccaaatcacttcaggcatttgcacaatgtctgaagctgaaccattcgaagttttagaaactggaaaagatgtaaaaacgccatctaagctagatgagcaacttaatcctgggttggacggagatgaagctgagaaacacagcttagactgtggtacagacaccagtcctgtgatgagcaagagaaccctttcttcaccaggatcaggaccatgccagcagtatgtaaatgaaagcaccaccagtacacagtcgactgataatcacccaaacgacctacccgctccgagatctcctgaacaatccgcgtgttttcagaatgacaacgattcgggttcagtaggcatttgtcaaagcagcaggcgaagaggtatagatgaactttgcggtaagctgcagagtttcaaagtttccagcgccgtaaaaggaagctacgtagctatgggtgcacctcgtccgaagcctggggacagcacgagccgatctgcagccgcgctgctcaggaacatagagaacacaactgctgttaaagctggccgtcctcctgtcaagccaaacgccgatggtaaggactcgtctaggcgagccctgcagcccataagcggaaggcctgacagtaggtag

SEQ ID NO: 196 - DNA, 1314 bp, Zea mays
atggacggccaggctccgccgcttctcgacgccgtcgtgctcgagccccttgcagttggcgacgagctccatccgcggcgtcctgtcgaggtggaggacgctccggccgccgctccgccctccggtatggacggccaggttccacctctctacaacgtcacgcgggatcctctgaccgtatccgacgagctgcagcccacgggcgaggtggtggatgacgccctactcgtcgcgcccgatatcgtcaagggcgaggtgatggaggacgacatcctacccgtcgcaaccgacatcatcaacgacgccgcctcggagtgccccgaggctggcagtgatggcgtcgtgctcaccgacgagctccgcaatcgcatcgtcaagcaggtggagtactatttcagcgatgagaaccttcctacggacgagttcctgctgaattatgtgaagaagaacaataagggctttgttcctattgagatcatcgcatcatttaggagaatgaagaaactcgttcaagacctctcagtaattgaagctgcactcaggacatcatcaaagctggttgtaagttcaaatgggaaacgggtcaggaggttacatccattgccacacaaagaattgaaagattcaaagaaaagcactgttttggtcgaaaatctacctccagatttctcaatggagagtattcaggaaaaattcgcaacagtgggcaaagttgtgaacataacaattaatgatccagaatcagtgaaagaattttcaactgctaagaagcctgacttcaatttaagttttaaggctcatgtacttgttgaatatgaagcagtggaggctgctgagaaggctgttactgccctaagtgatgagagcaactggagaactgggatgaaagtcaggcttctgtctaaacaaagtgtaatgggaccaggaaagtataaaaaaccttctaaagaaaatcaagatgcagtttccaaaatgattgatcagaatcaacattcaaaagaagaccagcttaaaaccttggaaaagatctccggtgctgatgcagtggggattaccaaggacagagataatttgaaacctgtttttatcactgagactgagcaccaagatcagaagccaaatgctagaggacgaaaaggatggtacaaaggtcaaggtcagatgcagcaaaatgcaaacaaacaaggcagttgtggttccgagtcattaaacaagcctatttctggaccgaggatgccagatggaacaaggggcttcacactgggacgtggtagatctcttccactacagaagtctgagaaggctgaagagtag

SEQ ID NO: 197 - DNA, 861 bp, Zea mays
atgccgaagggcgccaagaagcgcgccaagctcaagaagcagcagcagcagggccaccccgacgatgccggcaacaccaacgccagcaacggcaactgtaacggctgcgatgacaacaacagcgcctcgagcggccgcgacggcgaccaccacctgcggatcccacccaaagtttctcgtgtggatgcgaacgaggactccatggagagctctgaggagatggtcaccccccgagctgccgcgtcggagccggatgaggaggagactaaggccactgcggccgaggtgcccgtggagcgcaccgtcgacgcggacgtcgccggttctggggaggtcatagtggacgcgtttccgccggaaaccgttggacaggaacgtgagggcaaagtggatgaggcagaggtggaggtgcacgccgtggtggcgcaggaaccggaggtaaaagatgtggtggtggccgaggaatccgtggttcaggagccagtgtctgacgcaccggtggcagaggcttcagaggtgaaggagttggccaaggtgcattcggtgcttgaatctgagccgagggttgatgaagggcgtgatgaagtggtggtggtcgacgaaacacctgtagtgcctgaggtacaggaaccagaggtgaaaggcgttgatgctaccgttgtgttgaaggaacaagagaagaatagtggcaatgtggtggccaaggactctgctgaggtttcgcgctctcaggaggctgctggtgtgcatattacagaggtggagcggggacctgcagtggcagtgattgctccagggcagcgggcaatatggtggaatttctgcggcctttttgatgcctttactggttcagggagatag

SEQ ID NO: 198 - DNA, 2370 bp, Zea mays
atggcgcagcagctcccctgcgtctcgtcgccgcgcccgctgctcgccgtgcccgcgggccggtggcgcgccggcgtgcggggccggcccaatgtggcgggactggggcgggggcggctgtctctccacgccgccgccgcgcggcccgtggccgaggcggtgcaggcggaggaggacgacgacgacgacgacgaggaggtggccgaggagaggttcgcgctgggcggcgcgtgccgggtgctcgcgggaatgcccgcgccgctcggcgccaccgcgctccgcggcggtgtcaacttcgccgtctactccagcggtgcctccgccgcgtcgctgtgcctcttcgctcccggcgacctcaaggcggatagggtgaccgaggaggtgcccctcgatcccctgctcaaccgaacgggaaacgtgtggcacgtgttcatccacggggaccagctgcacggcatgctctacggatacaggttcgatggcgtgttcgcccctgagcgcggacagtactacgatgtgtccaacgttgtggtggatccatacgctaaggcagtggtaagccgaggtgaatatggtgtgcctgcgcctggtggtagttgttggcctcaaatggctggtatgatccctcttccctataataagtttgattggcaaggtgacctaccccttgggtaccatcagaaggaccttgtcatatatgaaatgcatttgcgtggattcacaaagcacaactcaagcaagacaaaacacccaggaacttacattggtgctgtgtcaaagcttgaccatctaaaggaacttggagtgaactgtatagagctaatgccctgccatgagttcaatgagctagagtacttcagctcctcttcgaagatgaacttctggggatattccacaataaattttttctcaccaatggcaagatattcttcaagtggcataagagactctggatgtggtgccataaatgaatttaaagcttttgtaagggaggcccacaaacggggaattgaggtgatcatggatgttgtcttcaatcatacagctgaaggtaatgagaaaggcccaatattatcctttagggggatagataatagtacatactacatgcttgcacctaagggagagttttataattattctggttgtggaaataccttcaattgtaatcatcctgtagtccgtgaatttatagtggattgcttgagatactgggtaacagaaatgcatgttgatggttttcgttttgaccttgcatctatactgaccagaggatgcagtctatgggatccagttaatgtgtatggaagtccaatggaaggtgacatgattacgacagggacacctcttgttgccccaccacttattgacatgattagcaatgacccaattcttggaaatgtcaagctcattgctgaagcatgggatgcaggaggtctctatcaagttggtcagtttcctcactggaacgtttggtcagagtggaatggaaagtatcgcgataccgtgcgtcagttcatcaaaggcacagatggatttgctggtgcttttgctgaatgcctatgtggaagtccacagttataccaggcaggggggaggaagccttggcacagtatcaactttgtatgtgcacacgatggatttacactggctgatttggtcacatacaatagcaagtacaacttgtcaaatggtgaggacaacagagatggggaaaatcataatcttagctggaattgtggggaggaaggagaatttgcaagtctgtcagtccgaagattaaggaagaggcaaatgcgcaatttctttgtttgtcttatggtttctcagggagttccaatgttctacatgggcgatgaatatggtcacacaaagggagggaacaacaatacgtactgccatgaccattatgtcaattatttccgttgggataagaaggaagaacaatcctctgatttgtacagattctgccgtctcatgaccaaattccgcaaagaatgtgaatctcttggccttgaggacttcccgacttcagaacggttgaaatggcacggtcatcagcccgggaagcctgactggtcagaggcaagccgattcgttgccttcaccatgaaggacgaaaccaaaggcgagatctacgtggccttcaacaccagtcaccttccggtggttgttgggcttccagagcgctctgggttccgatgggagccggtggtggacaccggcaaggaggcaccatatgacttcctcaccgatggcctgccagatcgtgctgtcaccgtctaccagttctctcatttcctcaactccaatctctatcctatgctcagctactcctccatcatccttgtattgcgccctgatgtctga

SEQ ID NO: 199 - DNA, 2733 bp, Zea mays
atggccgctgtggagccccggcagttcgggcgtctggagccgggctcctcgccagtgcgcgtggccacgaacggcgccaaggcgtaccctcctccggcaagccacctcccgcggcgcgctgactcccctgtccgcggctgcagcttccctcccctcgtctccccgccgcgcaggctggacgacgcgtcggacgacgaggacgaggagcaggaggactggcgagagctgtacggctcgcacctgcagctggaggtggagcccgcggtgcaggacgcgcgcgacgaaggcaccgcggacgcgtggatcgagcggaacccgtgcctggtgaggctgacggggaagcacccgctcaactgcgagccgccgctggcgcggctgatgcaccacggcttcatcaccccggcgccgctgcactacgtgcgcaaccacggcgccgtgccgcggggggactgggcgacgtggaccgtggaggtgacgggcctcgtgaggcggcccgcgcggctcaccatggaggagctggcgcgcgacttccccgccgtggagatccccgtgacgctggcgtgcgcgggcaaccggcgcaaggagcagaacatggtgcagcagacggtgggcttcaactggggcgccgccggcgtgtccacgtccgtgtggcgcggcgcgcgcctccgcgacgtgctccgccgctgcggcatcgtgccccgcaagggcggcgccctcaacgtgtgcttcgagggcgccgaggacctccccggcggcgggggatccaagtacggcaccagcgtcacgcgcgagtgggccctggacccgtcgcgggacatcatgctcgcctacatgcagaacggcgagccgctgctgccggaccacggcttccccgtgcgcgtcatcatccccggctgcatcggtggccgcatggtcaagtggctcaagcgcatcatcgtcacccccgccgagtccgacaattactaccatttcaaggacaaccgcgtcctgccgtcgcacgtcgacgccgagctcgccaacgcagaagcgtggtggtacaagccggagtacatcatcaacgagctgaacataaactcggtgataacgacgccggggcacgacgagatcctgcccatcaacagcattaccacacagcgcggctacaccatgaaaggatacgcctactccggcggcggcaagaaggtgacgcgggtggaggtgacgctggacggcggcgagacatggctggtgtgccacctcgaccacccggagaagcccaacaagtacggcaagtactggtgctggtgcttctggtccgtcgaggtggaggtcctcgacctgctcggcgccaaggagatcgccgtgcgcgcatgggaccagtcgctcaacacccagcccgagaagctcatatggaacctcatggggatgatgaacaactgctggttcaaggtgaaggtgaacgtgtgccgtccgcacaagggcgagatcgggctggtgttcgagcacccgacgcagcccggcaaccagcccggcgggtggatggcgcggcagaagcacctggagacggcggaggcggccgcgccgggcctcaagcgcagcacgtccacgccgttcatgaacaccaccgacgtcggcaagcagttcaccatgtccgaggtgcgcaagcacgcgtcgcaggagtcggcgtggatcgtcgtgcacggccacgtctacgactgcaccaagttcctcaaggaccacccgggcggcgccgacagcatcctcatcaacgccggtaccgactgcaccgaggagttcgacgccatccactccgacaaggccaaggcgctcctcgacacctaccgcatcggcgagctcatcaccacgggcaccggctacagctccgacaactccgtccacggcggctccgtcctgtcgcacctcgcgcccatccgcgaggccgtcagggctcccgcgctctccaacccgcgcgaaaagatccactgccgcctcgtcggcaagaaggagctgtcccgcgacgtccgcctcttccgcttctcgctgccgtcgcccgaccaggtgctcggcctccccatcggcaagcacatcttcgtctgcgccagtattgaagggaagctgtgtatgcgggcgtacacgcccacgagcatggtggacgagatcggccacttcgacctcctcgtcaaggtctacttcaagaacgagcaccccaagttccccaacggcggcctcatgacccagtacctcgactcgcttcccgtcggctcctacatcgacgtcaagggcccgcttggccacgtggagtacaccggccgcggcagcttcgtcatcaacggcaagcagcgccatgcgagccgcctcgccatgatctgcggcggaagtgggatcacgcccatgtaccagatcatccaggcggtgctgcgcgagcagccggaggaccacacggagatgcacctcgtgtacgccaaccggacggaggacgacatcctcctccgcgacgagctcgaccggtgggcggccgagtacccggacaggctcaaggtgtggtacgtcatcgaccaggtaaagcgcccggaggaggggtggaagtacagcgttgggttcgtcacggaggccgtcctgcgggagcacgttccggaaggtggggacgacacgctggcccttgcctgcggaccaccgccgatgatccagttcgccatctcgcccaacttggagaagatgaagtacgacatggccaattctttcgtcgtgttctaa

SEQ ID NO: 200 - DNA, 2688 bp, Zea mays
atgccgcccccttccgcctccgcctccccctccgcctcccgcttcgcgaagcactggatagctgacgtcctcgccggcgaagaatccgtcgacttctccctgctcaaggttctggtgggggcctcgtcgaagcccctcgcgggcgccccggaggccacgcgtgagcgggtcgcgctccggtccattcaggaggtgttgtccgtgatagccgctgggggtgatgccgcggccacggcgggggtgcttagtgttgatggcgcccggtcatgcgaggatgggctgtttcggcttatcagagaggttggaagtttcggagaattggagaaggatttgcttccacctttcagtcaagacatccaggaaaatatatgtaccaagaagtttacattaccaggaatttctttccagttgctagaaagagttgagccatggatagcatctatggccccacaaccccaaatggaacacaatggcactgaacaatgtgtcaatgatcagtcactgcgcagcagccacggatgtgtaaatatagagaagcctgtgttccatacagacaatgctggggttcagcaagagaccatggcagatgtagtcaatgaaagtgaaacaggaaatctccaaaaggatccacctgcaccaacttttatttttcaccaaccgtgtatgcctgaaagcaggtcttacgtccctccgcaagaagatactatagatgctgttggtctaggcgctaggtcctcagaaaggagtcctattgtggaggggaacatgtccgttggatctgtgcttgcttcagatggctgtgatgtacctttgcagggaagcattactgagccctttttccagcaggataaacatgaccatactgttatagttggaccaaaatcttgtaagcgaaaatctccaattccatcttactgtgctcatggagatggggcagatggtggtggctccagcaatcagtcatctaaggtttccattcgtgaaggacctagcactcatgccacagtaacttcaggttttgacagaatcagcgatgtcttaccaacagatgcacctgaatctgagcatttgcctgagtgcataactgcacaggatacaaccatttcacagcctgacagcaggaaagctcatttgagtgctctgcaacaggaaaggggtgagaaagtaacccaagatctggaagatatctctgcaaatattgggtcagtggaaaaggaccatattcatggggatctgactttgccatctgccagtgttttactttctataagctgcaatggtgctaatcaaggaagtaaatatgaaaccaaccttcaaccagggactgctacagaggatatgatggctttcgaagagcagaatgcagacaagtctcacttagaagtcagtggtatcaacaaggctaatcaagctctgcatgatgatggcggcgtcatgaaaaataatacagtacatggtgggttgattgtgcagactgctccagtgtctcaaaattgcaatgtaaccttacatgataaaacttcagagcaggaaaatgaaaagaacattcaaaaagataattgccatacttatgttccaggctcttctcaggataggggtggagaaagtgcaaagaaaacaacaaatgaactaaagtctggggacatttcttcaaaaatatgtgttcatttcaatgttcaagacatcaatgatactctggaggacttgtctcaacaaggtttgtgcataaaatgtggtgaaggtggtcagttgttggaatgcaatggctgttttttagccgcccatagcagctgttttggttcatcggcgacatttgaaggaaccaattttttctactgcccggtatgcttgtataagaaagccactgaagcatataaaaaggcaaagaaaacatattgtgaaactaggaagaaccttgttgctttccttggcacagcacaagccaccaatcaacctgacaaacaactaaatggagctcagccaggagctgccaacagagatgaagagcctcatgatgagcaacattctaaagggtgtggcgcatcaaaaggggcccatgaaaatgaagtatacaatcttgctcatcaggatgaagagcatcatcagcagaggaagaagcagaaaataaatgctataggtaagagttatcctaaggaggtactcactgagaaggttattttccagaactctgatcctgcatccattaataaacattcagtgctccagaataacaataaaacaccagttaaggatccagagaaaaagcagcaagcggtcaacgaagaagctcgcaaagaaggtggtaatgacaactcatctcatgaaacaggagcttcatctccgagaagatgtgatcctccttcgaatcaggacgttgaggctgaccaggacgatagccttacaacttctaatcaatctggtggttctgatgaaatagaagctacatcttctaatgactctgccaagcaatcatcacccccttggcgtggtatgggacacaacaaaaaaggattgcacgaaaaggagccagctgtatcaagtaaatctggaaaaggtattgggaaacaggatcaacatatgcatacttcacgaaggaaaaaaaaaatgcacacctgcaaaagcgctattccaatcctgttgcgccacctggaagacgcaaacaactctgttggacagaaaaagaagtag

SEQ ID NO: 201 - DNA, 210 bp, Zea mays
atgttctgtgacattacaaccatattttgttgttacgagtttactacttgcatgctacctagacctgtttctgtgggagcattcatatacttttggttaatatgtgatatgtcaatattctttatcaatacttcttctgttgtggatcttcaatatataactacattggacgaaccaaatcaccacaccgttatgttaccttttttgtga

SEQ ID NO: 202 - DNA, 2583 bp, Zea mays
atggagcgtgaggacgccgacggcgctctcgattcgtgggctcaattctgcactctttccaacgagcttctcgccggagacggtgatctcgccgtcggcccacgcctagctcccgtcgttggtgacctctgcacacgcggcctcgccacgctcgtccgcgactacttcctccactccctcgaggaaacatttcgaaaccatgcagtcaagaagttctggcagcactttcatccttattgcagtgcctcaaccgtagacagaattaagttctgtgttaaggaacattggcctgaagaaatcttaagtaaagcactggaggacatatgcttggaaaggggttaccaggaaaaatgtgttcttgttcttgtccaagttttacaatcatatgaggataggatgccacgaaaaaaaatcaaagaagtggtctgtagttccagcttaatgcctaggtatcagttaatggtatcatcagtacttctgacaacactgcccttgagctttcctgacatattgaatatctatttcaagaagaagctggaagaacttaatagtattatggctggatcttatgagagtgatcaacttgtggatcatgaaccttttcaaaggagtaatacatctgactggcattctggaatggacattgatggttctgaagtttcagaaaatagctccttggtaaagaacattggcaaagttgttcgtgatcttagatgtattggttttacatcgatgactgaagatgcttattcctctgcaataatctggcttttaaagtctaaggtttatgaactagctggtgatgattatagagtgtcagtcctttggtgtgtgaagaagtggattcaggctgttcctcttcagtttctgcatgctcttttaacatatctcggtgactctgtggaccatggcagtggatcttctggtctcaaatcaccattagcttcacgcccttcttccttcccagggattggtgttccttctgaagcccttgtgagatggcacatgcgccttgaatattttgcttatgaaaccttgcaggacctacgaattggcaaactttttgaaataattgtagattaccctgagagctctcccgctattgaagacctaaagctgtgtttagagtacacgggccaacactctaagcttgttgactcatttatctcatcgcttcgatatcgtctacttactgctggtgcatcaacaaatgatatattgcaccaatatgtgtccactataaaggcattgcggacaattgaccccaccggggtgttcttggaagcagttggtgaaccaattagggattatctgagaggtagaaaagacactatcaaatgcatagtgacaatgctaactgatgggtcaggaggaagtggaagtggaacaggcaatgcaggtgacaatcttctggaagagttgaacagagatgctgaaaaccaggaaaatgctgattacgacgatcatgcaaacattgatgagaaacaagcatggctcaattctgaaagctgggaacccgatcctgtagaagcagacccattgaaaggcaacaggaacagaaggaaggtcgatatacttggactaatggttagtataattggctcaaaggaccaactagtcaatgaataccgtgtaatgctggcagaaaagctgctcaacaaatctgactttgaaattgattcagacattcgcacattggaactcctgaagattcattttggtgagagcagcatgcagaagtgtgagattatgcttaatgacttgattgactcgaagagaaccaattcgaacattaaaacatctttgctgaagtcatctcaaactgttcctgggcaagaggaggcagaagtgtctcatgatgttttggatgccactataatatcatctaatttttggccaccaattcagatagaagaccttgttgttcctgcttcagttgatcagttgctatcggattacgcaaaacgatttcaccagataaaaactccacgaaagctattatggaagaaaaatcttggaacagttaagttagaactgcaatttgacggaagaagcgtgcaatttactgtagctcctgtgcatgctgcaatcataatgcggtttcaagagaaatctagttggacttcaaaggcacttgctacagaaattggcatacctatggattctcttaacagaagaataagtttctggacaagcaagggggtcctgactgaatcagcaggaccagatgccgatgatcgcaccttcactgttgtcgatagcatgtctgatgtcaacaaggacagtattgtgaatgaacgcatggcagagtatcagatgactgaggaggaaggtgaaagctctgtggcttcagtggaggaacagcttaagaaagaaatgacagtctacgagaaatacatcgtcggaatgctaacaaattttgggagtatgtcgctggacaggatacataacactctaaagatgttttgtattgccgagccatcgtatgacaagtcgctgcagcagctgcaaagttttctttctggtctagtagcagatgaaaagctagaaacgagggatgggctgtacttgctaaagaggtag

SEQ ID NO: 203 - DNA, 1389 bp, Zea mays
atgagctgcctccgccgcgcttcccgcctcacccggggtctctcttcctcctcggcggcggaggcggagacgctcccgccgccgcgcccctctgcgggtcgccgcgtggtcgtgacggggctgggcgccgtcacgccgctggcgcgcggcgtgggcgccacctgggatcgcctcgtcgcggggagatgcgccgtgcgctctctcgccgcagaggacctccgctttccggaggaagcagcggggaggacgctcgagcagctcccgtccagggtggtcgccgccgtgccgcgcgggaagggcgaggacgagttcgccgaggacacgtggaccaaggataaatctgtatcaggatttatttcctatgctctgtgtgcagctgatgaggctttaagagatgcaaattggttgccttccgaagatgataagaaggaaagaacgggagtctctattggtggagggattggaagcatctccgatatcttagatgcatcacaaatgatcatcgaaaatcgtctacgtcgtctcagcccatacttcatccccaagattttgatcaacatggcatcaggtcatgtcagcatgagatatggtttccagggtccaaaccatgctgctgtgacagcttgcgccactggtgctcactctattggcgatgctactaggatgatccaatttggtgatgccgatgtgatggtggctggtggaactgagtccaatattgatgctttgtctatagcgggattttctaggttaagagcattgtctacaaaatataattcctctccacttttagcttcaagaccttttgattgcggtagagatggatttgtgattggtgagggctgtggggtcatggttttggaggcacttgatcatgcaaaggaacgcggtgcaaaaatatatgctgaagttcgaggctacggaatgtctggtgatgcacaccacataactcagccacaaagtggtggtagaggtgctattttagccatgaagcgtgctttggaccagtcaggtcttcatgtaaatgaaattggttatgtgaatgcgcatgccacgtcgactcctcttggtgatgctgtggaggcgaacgcgatcaaatctgtatttggcgaccacgcagcatccggtgatcttgcaatatcctcaacaaagggagcaattggtcatctgctaggggcagctggatcagtggaagcaatcttcactgtgctagcaattcaccacggactcgctccgcctactcttaacctggagcggccggacccgctgttcgaaggggcattcacgccactagctgcgcccaagaagatgtcgatacgagcagccatctccaactctttcgggtttggtggaactaacacgtcgctgctgttctcgtgcccgccctag

SEQ ID NO: 204 - DNA, 1113 bp, Zea mays
atgtctaccgtcttcatgacccaactgccgcgtactctccgtctaatggagggagagcaggatcagggactctttccggcgtcgaccttccatgtcgcaaaggaccctccaatcttgttcccgttcatgatcaccagccccgtccatgtagatcagctccaagggcaaagcagctatggtgatcagcacttggggcagcatgtcttgtctgaatctactcaacagttcaccgatcggacgatgataagtgggtcagaagtcttccctaggcggccatcgccgttcgggcagactatccaaagcatcgatggtgatatgatccagccatctgcgtatgatccatatgatatagtggagaaccagcgcacggaaggattgagcggcggcggctggacagtgtcgtcgtcctcgtcgtcaccgccggcgaagatgaagatcatgcgcaaggcgacgagcgagtatcccgagggtggagctgcaagaaagccaaggagaagagcccaagcgcaccaagacgagagccagctactgacgatgcagcagcaggctatgggcgtcgtcgttagagtgtgctccgactgcaacaccacaaagacccccttgtggaggagtggtcctcgtggccccaagtctctctgcaacgcatgtggcataaggcaaaggaaggcgaggcgggcgatggtggccgcggccgcggcagctgctgccagcaacggaggcgcgcctccacaagcggtgagcggcgttgccacccagcagcagccgaagccgaagccggccaggaaggagaagaggtcggacgccgccgaccggtcgctgccgttcaagaagcggtgcaagatggtggttgtcgatcacgctgccggtgcagcggcagccacggcgacgccagaggccgcagctgctcggagtaccaaggatcaagcggatcacgtctccggcgacaagcaggttgttgcccctgccgccgcgatgaggagtctggatcagagcgagatcgccactcctcctccctcggcggtgtcgtcgtttcatgctgctttcccggccgacgagatcaccgacgccgccatgctgctcatgaccctgtcctgtggtctcgtccgcagctag

SEQ ID NO: 205 - DNA, 1212 bp, Zea mays
atggctttcctcttcaacaagttccaagaggcaatcagaacaattgccaagagccccatgtttgctcgtgatccaaggcatcttcaatttgaagctgatgtgaatcgtttgtttctctatacaagctattatcgtctcggggagaatgctgacgagaaggacgctgaggagattattgacttggctagcaaagcttctattgctgatcagcagaaacaagtgcaggataatgttcattatgaacttacgcatatgtgccaagcaatggatagcattttatgtcctgatacaataaacgacccatcaaaaggaccttcagaagcacataatcattctcagcgtagtggcttaagttttgccgttggtggtgctgcatctgcaaacaagcaaagtgcaattatccctgctacacgacctttaactcgagcagaattgtcaaagaaattcagggatcattttgggtacacacttgacatcggaccatctggaattcctcataaagacgcaggtcaaggtttattcttatcaggacaagcaaatgccggtgctgtcctagccatctatcctggtgttatatattcacctgcttactatcgatatatacctggatacccaagaattgatgtttgcaacaactatctaatcacaagatatgatgggacaataattgatgcaaaaccatggtgttttggtggtgaaacaagagcattatgggatggttcagatttggtggattacaatgctatggcacctaaaggctcagagaacaactctgatcgggtgtggagaatgctaagcaagcctctagaaaaaggtgtaagggaaaattttggtgaagtgcttgaacgacgaaatccccttgcttttggtcattttgcaaatcatccacccaaaggttcaagtcctaatgtcatgatctgcccatacgattttcctttgacagagaaggacatgagagtatacatccctaacattacgtttggtggtcaagagaccattaggatgaagaggtttggctccttctatttcaagtctggaggttctgataatcaggctggtgattctctagtactgaagacgctagtgctggtgagcacaaggtccatatgtgatgaagagctctttcttaattaccgttacagtaactcaaaaagacgaccagagtggtacagccctgtcgatgaagaagaggataagaggagatggagctag

SEQ ID NO: 206 - DNA, 795 bp, Zea mays
atgagcagcacgaagcctcacaaggcgaacgattcgcggtgggaggcgatccagacggccagagctagagacgggatccttggaccgagtcatttcaggctgctgaagagactaggctccggcgatattggcagcgtgtatctctcggaactgagtgggaccgcgagctatttcgcgatgaaggttatggacaaggcatcacttgcaggtcggaaaaagctgcttcgggctcaaacagagaaggagattttgcaatgcctggaccatcctttcctccctacactttacactcacttggagaccgacaagttctcctgcctagtcatggagttctgccccggtggagaccttcacacccttcgacagaggcagcctggcaaacatttttcggagcaagccgtcaaattctacatagcggaagtcctcctggcactggagtacttgcacacgctcggtatcatataccgcgatctcaagcctgaaaatgtccttgtccgggaggacgggcacatcatgctctcggacttcgacctctctcttcgttgtgctgtcagtccaacactgatcaggtcctcaaaccctgacgcagaactgcagaagcgctcaggaagagcagccaaggctactgtgttgagccagcctgtgttgagccgtcctgcatcactcaaccgtcgtgtgcagccccaaccacctgcttcggcccacgcctgttctcctccaagtccaagaccaagagagaccggtaaccaaaaccagaagttgccaccccgatcagcccttggcctgagctcatag

SEQ ID NO: 207 - DNA, 2001 bp, Zea mays
atggaacatacatatcaatatgcctgggtaattcctcttctcccacttccagttattatgtcaatggggaatttggactttttcttattcctacagcaacaaaaaatcttcgtcggatatggggcttttcctagtattttactcttaagtatagctatggtattctcacttcacctgtctattcaacaaataaatggaagttctatctatcaatatctatggtcttggaccatcaataatgatttttccttagaatttggatacttggtcgacccccttacgtctattatgttaatactaattactactgtaggaatcttagttcttatttatagtgacgattatatgtctcacgatgaaggatatttgagattttttgtttatataagtttttttaatacttccatgttaggattggttactagttccaatttgatacaaatttattttttttgggaacttgtcggaatgtgttcctatttattgataggcttttggtttacgcggccaattgcagcgagtgcttgtcaaaaagcttttgtaactaatcgtgtaggggattttggtctgttattaggaattttaggttttttttggataacgggtagtttggagtttcgggatttgttcaaaatagctaataactggattcctaataatgggattaattccttacttactactttgtgtgcttttttattattccttggtgcagttgcaaaatctgcacaatttcctcttcacgtatggttacctgatgctatggaaggacccactcctatttcggctcttatacacgcagcaactatggttgctgcggggatttttcttctagctagacttcttcctcttttcatatccctaccctggataatgagtttcatttctttaataggtacaataacactcttcttaggagccactttagctcttgctcagagagatattaaaagaagcttagcctattctacaatgtctcaattgggttatatgatgttagctctaggtataggttattatcaagctgctttattccatttgatcactcatgcttattcgaaagctttattgttcttaggatccggatccgttattcattcaatggaacctcttgttggatattcaccagataaaagtcagaatatggttcttatgggtggtttaagaaaatacgttccaattacaagaactacttttttatgtggtacactttctctttgtggtattccacctcttgcttgcttctggtccaaagatgaaatccttagtaatagttggttgtattcacccttttttggaataatagcctcttttactgcaggattaactgcattttatatgtttcggatatatttacttacttttgatgggtatttgcgtgttcattttcaaaattacagtagtactaaagaaggttcgttgtattcaatatccttatggggaaaaagtatatccaaaggagtcaatagggattttgttttatcaacaatgaagagtggagtttcttttttttcacaaaatataccaaaaattcctgctaatacaagaaataagataggatcctttagtactccctttggggctaaaaatacttttgtctatcctcatgaaacgggaaatactatgctatttcctcttcttatattactactttttactttgttcattggatccataggaatccattttgataatggagtaaaagataatagaatattggagttaaccatattatcaaagtggctaactccttcaataaacttgttccaggaaaattctaattcttccataaattcatatgaatttctcactaatgcaatttcttctgtaagtttagcaatttttggtctattcatagcatatatcttttatggatctgcttattctttttttcagaatttgaattttcaaaattcccttgtaaaaaagaatccaaaaaagagctttttggatgaagtaaaaaaaagatatacagctggtcatataatcgtggttatatag

SEQ ID NO: 208 - DNA, 690 bp, Zea mays
atgctccccacgtcgcctccccccatcgcccaccagccgtcgcccaccagcccacactatctcacgccatggatggtggcaacagtccccgcccccgtacctcacacgcatcaggctgggctggccgatcccgccgccgcaaacgccgcgcccagccccgatgtcagcgcggcccgcccgccaacgcactttcggcctccccccgcccctcccttcgcccgcccacccgcaacctccgcgccatccgcaacctccgcccgcttctcacgccaccgacccgacctccgcgccatccgcaaccgtcgtgcgtcttatcccttctctaccgcgcactccgtgtggaacaacctccgcgtaggaagcctcctcccttccccatccccattccccaccacgcgcttcggggacggcgagctccgggcgggagcgaccgccgggcgcttctgctgctggtgcggaggaggaggagcggcgagggtggttcggcgcaggctccacggcggcggtgcccgagccgagttcgactggctggcgctctactgcaacctcacacgcggcgatgggccggacggtaacaatggcaagctggtcctggaggagctgctgtcgtgcgccgccacccaattttgttttccccaaatcctgagctgtgaagagaagaagaagacaaggacgcggcgagtacgatga

SEQ ID NO: 209 - DNA, 1362 bp, Zea mays
atgctgacagctccaccgctcgccgccgccgcccgccgcgccgccacagctgccgcatgtggcgccgcccaccggctcctccttccagtttgctttctatcctccaacccctctgccccgagcactctcgtaccgcgccgccgcttcggccacatgtcgcaggagtgcatggccccgcgcgctcccctaccgccggtcggacggaactttgcggtggctgtgggggatgagatcctgtatggagatgccccggagctggttgtggtgtcgttctaccggttcgctgatttccccgaccatgctgcattccggctgccgcttaaggagctttgcgaggagctgcgtgtttcaggtggcattatccttgcacctgagggaatcaatggtagtatatgtggaaccccagttgctgtggacaaaatcttaaactttattcaagaagacggtcgtttaaaaggattgagaatgatccagtcacctgttactccagaggatgaggccatacatcatggacataccagtcactcccctgttggtgctggggaagatgcaccattccgatgggatcatgtccgtgtcaaattgaaaaaggagatagtgacgtttggagacccaggtgttatgccaactaaaatcgttgggaaatatgttaagccaaaagactggaatgacttgataagtgatccagacactgtcatcattgatgtgcgtaacatgtatgagatacgcataggaaagtttaagaaagctgtcgatccacgtacaaactcattcagagagtttcctacttgggttgacgatcaatttcaattggttcaatcaggcaccctagggtcagggggagatgataatggaaccggtgaaccatcggcagaccttaatgccagcaaatccaaacagctaccaagagttgctatgtactgcactggtggtatccgatgtgagaaggcatcaagctttctcctcggcaagggctttaaagaggtttatcatttggaaggcgggatattgaagtatctggaggaaatcccaaaggccgaaagtttgtgggagggtgaatgctttgtgtttgacaagcgtgtctctgtggggcatggattggcccaaggcacccacaaactttgctacgggtgtaagcagccagtcagcgatgaggacatgttgtcgcctcactgggagtacggcgtctcttgcccgcattgcttcgcaacgaaatccgaggaggagaaggaacgggctagggctcggcagcggcagttcgagacctttggagtgataggtgggcctcatatgggcaagagtccgagagggtctgccgctaacaatgcagtggagttcatacagttgcccaagtcagtgtaa

SEQ ID NO: 210 - DNA, 2916 bp, Zea mays
atgatcgtgcaacccatcgagctacgcgcgtggactgccttccctgggtcggcgcaggaggggatcggaaggatggcggcgtcggtttccagggccatctgcgttcagaagccgggctcaaaatgcaccagggacagggaagcgacctccttcgcccgccgatcggtcgcagcgccgaggcccccgcacgccaaagccgccggcgtcatccgctccgactccggcgcgggacggggccagcattgctcgccgctgagggccgtcgttgacgccgcgccgatacagacgaccaaaaagagggtgttccacttcggcaagggcaagagcgagggcaacaagaccatgaaggaactgctgggcggcaagggcgcgaacctggcggagatggcgagcatcgggctgtcggtgccgccggggttcacggtgtcgacggaggcgtgccagcagtaccaggacgccgggtgcgccctccccgcgggcctctgggccgagatcgtcgacggcctgcagtgggtggaggagtacatgggcgccaccctgggcgatccgcagcgcccgctcctgctctccgtccgctccggcgccgccgtgtccatgcccggcatgatggacacggtgctcaacctggggctcaacgacgaagtggccgccgggctggcggccaagagcggggagcgcttcgcctacgactccttccgccgcttcctcgacatgttcggcaacgtcgtcatggacatcccccgctcactgttcgaagagaagcttgagcacatgaaggaatccaaggggctgaagaacgacaccgacctcacggcctctgacctcaaagagctcgtgggtcagtacaaggaggtctacctctcagccaagggagagccattcccctcagaccccaagaagcagctggagctggcagtgctggctgtgttcaactcgtgggagagccccagggccaagaagtacaggagcatcaaccagatcactggcctcaggggcaccgccgtgaacgtgcagtgcatggtgttcggcaacatggggaacacttctggcaccggcgtgctcttcaccaggaaccccaacaccggagagaagaagctgtatggcgagttcctggtgaacgctcagggtgaggatgtggttgccggaataagaaccccagaggaccttgacgccatgaagaacctcatgccacaggcctacgacgagcttgttgagaactgcaacatcctggagagccactataaggaaatgcaggatatcgagttcactgtccaggaaaacaggctgtggatgttgcagtgcaggacagggaaacgtacgggcaaaagtgccgtgaagatcgccgtggacatggttaacgagggccttgttgagccccgctcagcgatcaagatggtagagccaggccacctggaccagcttctccatcctcagtttgagaacccgtcggcgtacaaggatcaagtcattgccactggtctgccagcctcacctggggctgctgtgggccaggttgtgttcactgctgaggatgctgaagcatggcattcccaagggaaagctgctattctggtaagggcggagaccagccctgaggacgttggtggcatgcacgctgctgtggggattcttacagagaggggtggcatgacttcccacgctgctgtggtcgcacgtgggtgggggaaatgctgcgtctcgggatgctcaggcattcgcgtaaacgatgcggagaagctcgtgacgatcggaggccatgtgctgcgcgaaggtgagtggctgtcgctgaatgggtcgactggtgaggtgatccttgggaagcagccgctttccccaccagcccttagtggtgatctgggaactttcatggcctgggtggatgatgttagaaagctcaaggtcctggctaacgccgatacccctgatgatgcattgactgcgcgaaacaatggggcacaaggaattggattatgccggacagagcacatgttctttgcttcagacgagaggattaaggctgtcaggcagatgattatggctcccacgcttgagctgaggcagcaggcgctcgaccgtctcttgccgtatcagaggtctgacttcgaaggcattttccgtgctatggatggactcccggtgaccatccgactcctggaccctcccctccacgagttccttccagaagggaacatcgaggacattgtaagtgaattatgtgctgagacgggagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagcggagcaggctgaattcttctccttcggaacgaacgacctgacgcagatgacctttgggtacagcagggatgatgtgggaaagttcattcccgtctatcttgctcagggcatcctccaacatgaccccttcgaggtcctggaccagaggggagtgggcgagctggtgaagtttgctacagagaggggccgcaaagctaggcctaacttgaaggtgggcatttgtggagaacacggtggagagccttcgtctgtggccttcttcgcgaaggctgggctggattacgtttcttgctcccctttcagggttccgattgctaggctagctgcagctcaggtgcttgtctga

SEQ ID NO: 211 - DNA, 1677 bp, Zea mays
atgggcacaccaatgtcgccgtggaaggggcggctgcgctctcaccacgcgaccgttcaaagtttgtccaagaggaggctcccttctcggaccaagaacccggaggagaaagagaagctccgaacatcgacgaagaaggctgccccgaagaagacggcgagaggtcgccccgctggagctgctcaacagcagccgatggctcgcttaggactgtcgtcgcggcatgctggaagagactctgagcatccagttgtgatagacgatgatgtaaacggggaatgtaacggcagggctgatcaatcagcaactacgcctctccgcaggtccccacgactacacgtggaagataagagtttgggcaagtcaccattgccaccaaatcgccgggagacctctgctaacagaaagactaaaaatgctcataggaaatacaaaaatcaagagagcctgaaaaggaatagcgcaagtgctgcattatcacctaggaaagatatttcagatgtgtctaacaaaaagagtgacaaacatgagttaaagcccaaccgttgtgaagtgctaacaggaaagaggaagagaggaacagaaaggaggctgtcatcgaagaagcaacgttgccaggatcccaaactattgcctgcggtttgccaagagattgcaccttgcaatgaacccagaaaatctacacacagaaggattgaaaaggacccctctattgaggaatttgaggtgaagcttaaagttgctaatgagagattgacaaacattgatgaaaacatcaacaagctaagtgggaccgagagagaagaaatgggaaatttctgtggttctgattggacaaaagagcaggacatggcattgcgcaaagcttacttcagtgcccgaccatccccacatttctggaagagagtttcaaaaatggtgccagggagatctgctgaagactgcttcaacagaatttataatgacctctcaacaccgactccaattgcaccacgtcccagaacaagtaaaacaacattttctcctataggaaatctcacattatctgatccaaagcttccaaatatcttggaacctacagtcggaaggcaaaagaccgctaaccaaaagagtctagtagcacagaagacagttaggcatttgttgcagaagcattgccgcattgaccaagctcaagaggccgaccacttctcaatttttgaaagctcaccaagtgccttacaattgaacttatcttttgaagattctcctggtactcctgacagttatatgaattcagattctctaggcaagcacagtggaagttcttcagcacggaagaaaccattttcaaggttaagaactaagccatctgaaccgagcccagcagttctaaagcctataaagaatgctatcttacatgagaagtacattgatcaattggcacgtagagaaggcacaaaaaggcctcgcagaaggactccagcaggctctaaaactgctgattctgggaagtctctttctgagcagcaagctggtagtctgaaggctgctaaaaatgctctcatctcagaagcaacggacttcataagcagttttaaggcgctgcaagccaattcccttgcacatgttgtggagaatagcgaagacgagattgaatgtgatgccagtgattgtagctatgctgataaagaatga

SEQ ID NO: 212 - DNA, 960 bp, Zea mays
atgatggctaaggccaatggagcagtccatgcatccacgaaggaacccttgttttcttttggtgtcatagctgatgttcagtatgctgatatcccagatggtcgctcattcctcggtgtcccaagatactaccgccatagcatcactgtcctccaaagggccgtcaacaggtggaacgaacaaggcaacatcaagttctcaatcaattttggtgacattattgatggctactgcccaaaggacaaatcattgtgggcggtgcagaaggtccttgatgaatttgacaagtttgatggcccgacatatcacatgattggcaaccactgcctgtataaccttccgcgcagccagctggtgtctctgcttaagattgcaacagattctgatcgtgcctattatgacttctcgccatgccctgggttcagaatcgttgttctggatgcttatgacttcagttgccttggctggccccatgatcaccctgtgactatagcagcaatgaagctcctggatgagaagaatccaaacactgataagaacagccctgatggtctggttggtgttgataggcggttcgtgaagttcaatggtgcagttggcaaggagcaggtgtcctggctcaatgatgtcctccaggacgcatcgacgcaacatcaaaatgtcatcatatgcagccatctcccaatggatcccggggcgtcttccccagcagctctgatgtggaactacgatgaggtgatggctattgttcaccagtacaactgtgtcaaggcctgctttgccggtcatgaccacaagggtggccactctgtggactcacacggtgtgcaccaccgcacccttgaggctgccttggagtgtcctcctggtaccagcgcttttggtcacgtcgaagtgtatcctaacaggctgctgcttgtaggttttgacagaatggctgatacagaggtccgtttttga

SEQ ID NO: 213 - DNA, 1695 bp, Zea mays
atgagaaattttatagagctcctcgaagcttcaagctcacaccggctagcttccctcagtcgcaggctcacaacatcatcagctcactctcttctccatcctcttctcgaatgtgccaccaactccccaaccccaccccaaaagatcaggtttcgatccacgaaccccctcccaatcctccaaagatcaccgctctcagacccctcctccccggcaatggcagccggtggcccagcgctgctgcgtgccctcctcgtcgcggccctctgcgccgtcccgtggcgggccgaggcggcgatcggggtgaactggggtaccgtgtccaaccaccgcgcgccgcctggcgtggtggtggacttgatgcgcgcgaatcggatcagcaaggtgaagctcttcaacgccgacccgggagtcctgcgcgcgctcgccggcagcggcatccaggtcatggtcggcgttaccaacgacgagctcgcaagcatcgcggggtcgcaggcggctgcagacgactgggttgcgcagaacgtgtcccgttacgtcggccgcagcggcgtcggcatccgatacattgctgtgggcaatgagcctttcctgacaagctaccagggtcaattccaatcatatatcattccggcgatgacaaatattcagcaatcactggtgaaagctaatcttgctagctatgtaaagctagtagttccctgcaatgctgatgcttatcagagtgcttctgttccatctcaaggagtattcaggactgaattgactcagctaatgacccagctggctgcttttctgagttctagtggggctccatttgtcgtcaatatctatccattcctcagtctttatcaaaattcagatttcccacaagattatgcgttctttgaaggatctactcacccagtagtagatggtccgaacgtgtactacgatgcatttgatgggaactttgacacattagtttctgctctcagtaaaattggctacgggaacctaccaattgcaattggtgagattggttggcctactgagggagcaccaagtgcaaacttaactgcagcaagggcattcaatcaagggcttatcaatcgtattacaagcaacaagggaactccactccgacctggtgtgccaccagctgatgtatatcttttcagccttctcgatgaagaggggaagagcatactaccaggaaactttgagcggcactggggaatcttctccttcgatggacaagccaaataccccctgaatcttgggctgggaaattcagtactgaagaatgccaaagaggttccgtaccttccatcacgttggtgtgtcgcaaaccctgctcgggatcttgacagtgtttcagatcacatgaagcttgcgtgcagcatggcggattgtaccactctgtactacggaggttcatgctatggcatcggggagaagggcaatgtttcatatgctttcaacagctactatcagcagcagaagcaggacccaaagagttgtgattttggtgggcttgggatgataacataccttgacccatctatgggcgaatgccgctttcttgttggtgttgatgatagcaagagctctgcagtcgcctcttgtggcggtggatgctgcggggtctgctgtggactctgggttttagctttgtgggtgctcacgtaccttagaatgatgggttccgcttga

SEQ ID NO: 214 - DNA, 1848 bp, Zea mays
atgcggggtggcggcggggcttcctggctttcgtttcgcggcgtggtggtggaggaagaagaggcggtggtttcggcgccggaaaagccaatgcggcgggggcggcggaggtggggagcggaggtggacgacggctactcgccgagctccacgggcggcggcgggagcagctgctgcgattccttcggctgcgactcgcctttggccgggttcgtgcgcccagatggtgacccagacacagatctggagacagatgggttggccacttccacctccagtgcttctgcagcctttaccgagcggcaggacgacgaagcggaagaggcgctgtacggggtgaaggaagaggagtgggctcagatacaagaaccagccaagaatccggcattccgtgccaccccagaatgccacaaacagcggtaccggacggatgctgctgttcttttgcatggtaggaaggggtcgaaacagcggccggcctcacttgacctcggtagccctgggttccatggagccacgttttctccaagtttcgtgattggtggtgtggggttgatgaacaaaggacttggagcatcagtcatcaggtcagacgtgtttcatagtcctgggacgccgaactatccgcgccaccgtgcatcagtgttagggtgccataaagggtggagctctgagagagttccacatccttctaaaggaaataggcggtacccaggcagcagcatggcatttccttacagcaatgggaggacattgccctcgaaatgggaggatgcagagaggtggatcttcagtcccaattccagcgacgcgcttggaagaactacggttgctcatgctcggcgaccgaagtctaaaagtggccccctggggcctccaggaagacttggtggacagtattcatctgtttcttcagtgtcattgcttgataatgggagagctggacctattacagcaaattcaccttttgcggctggagtactaatgccggaacatgtttgtgaaggaaaaagtacaaatggaacctattcaagtagaccaattggtaacgaaatcaacattggaagaggagtcaaaatttgtccactgaatggtgggtctcatcctgttcgaacttccagagttcgccagcgattagattatgcagtcgaatcatctgtttcattgcctagcacgcaagaatctgtccaagacgagcaggttgaaatcacagaagattcagcttctactattgcttctataatttctagaaaagatgctgcaacccagaccagtccagagctaagtaggtcctcttcacccaacactagaccaacatttaatggttccttgtcaacagaacaagtgaaagagaaggggagctgtttgtcagatcttgatatcagggatgttcagatggatgatcgagtgactttgactaggtggtcaaagaaaaatgtaacacggtcgtctaacaagaattcaacaaacataatagagtggagcgaaaagacagtggaatcaaaatcttcgtcctggggctttgccaaagcgaagtgcatttctaagattgatagagaggacacagaaattactgcatgggagaatattgaaaaagcaaaagctgatgcagcaattcagaagttagtgattaagttagagaagaaaaggtcatcttcgcttgataagattttgaacaccctcaaatctgctcaaaggaaatcccaggtgatgcatgagcatgagcgtgatgcagtaacagcaaaccaagatggaaaaggctctaggaaggcaaaaaagagagcacaactcagcaagaatggccaaatcagttcactgagtggctgcttcacttgccatgctttctga

SEQ ID NO: 215 - DNA, 1707 bp, Zea mays
atgaggagcaatagacgacgccttggaggaagaggaggaggatggggtggccagggcggtggtgtaagtgtggccgcttccttcgccgcgctgttgggctgtgtcgtggccctcgtcggcggcgccgccgggcagggcccccggcccccctccgactacaaaaccctcagcggcgccgctccacttgtggtggccaaaggtggattttcaggagtgtttccagattctagccaaggcgcctattctttcgcgatgatcaccagcgcaccggacacggccatgtggtgcgacgtccaactaacaaaggatggtgttggagtctgccttcgggatataaatatgaaaaactgcaccagtgttgatcaagcctaccccgagagaaagcggacctatgtcatcgatggtgtgcggaaaactggatggtttgtttcagacttcaccattgctgagcttcagtctgtttctctaacacaagcaatttggcctcgcactaggagattcgatggcatctatcctatcatcagtattactgactttcggtcccttgtcatgccatctcctgtttggttgaatgtacagcatgacatcttctacaaacaacatggtttggacatgaggaactacatactttcgatcaaaaagggtgtatccatggattatatctcatcacctgaactgggcttcctcaaaaatatgtctggaagagttggtcgcaaaacaaagcttgtgtttagatttcttgaaaaggccctcttagatcattctataaatcaaacatatggttcactgtcgagtaacctaccatttattaaatctattgcatctggcataatagtccctaagagttacatttggccggtgacgaaggataactatctactgccatccacatcaattgtcacagaagcccacaatgcagggctggaaatatatgcctctgattttgccaatgatagaattatcccctataactacagctatgatccgttggcagaatacctgaactttatcaatgatggtggcttctctgttgatggtgtattgtcagaacacccaattactgcatcagaggcaattggttgttttactaaactgaattcaaataagactgatcatggagaacccttagttatctcacataatggtgctagtggagactacccggactgtacagacttggcctaccatagtgcaattgatgatggtgcagacatcattgactgtcctattcaagtgacaaatgatggagttcttatgtgcatgagttccactaacctgcttgacactacgaatgttcagagaacaacttacaactctctggtttctgtcgttccagatattcagcctcaaccaggaatcttcacattcaacctcacttggtccgacattaacagtaatgttttaaaacctaaaatatcttctccagtgagtggttatttccttgtaaggaacccaagatacacaaatcaagggaagtttttgaagttatctgactttctagcaatcgcaatggataaagacttgtctggtgtcatgatcattattgaggtgatactttcgctcaaacattgtattaaaaagaagacattctcacataggtcgagaaaacctccaaactcctgctccacttatacacagcggcatcattgcccatgtaaggacgaccgcaaccggggccggaccttagaccttagacttgtactttga

SEQ ID NO: 216 - DNA, 1050 bp, Zea mays
atgagcacctctccggccgcgtccgccgccgcgtcgcctccgccgcctattgcctccgccgccgaggcctcgcgggcgacggagacgttggtggtcgacgagagggtcgcctcacacgtggacccgttcctcgtagaggcgctcgacaaccctcgccaccgcctcatggttctacggatggaactggatatacgaaactttatgcagaaccctcagctgcaggagttcgaattccagaactttccgacttcttacctacgctgtgctgctcatcgtgttgcacaacattatggcttagagactatagtggcagatagtttagtagaaggctcagttagcaggatcgttgcaagaaaaacaccagagagcaggtgtcctgcaatttcattagcagaagttcctagcaaacaagcaagaaatgatcatgaggcagcagagaagcttaagtttgtcatttatcaaaggcccaaagcattccaaaatggaagcactgatttgggaaacaagaatggtgcaccaaaaactgttgaagagagaatagaggaatataataaagcacgagcacgcatcttcaatggttctgtttctgcagattctgatgctgcaagtgttttgggaactctttgcactggcagagatgagtcagtaaatgttgaaccttctgttgatgaaatcaaagtcagcacgatgaacaaccgttccagagttgctgttttcaaggatactcaaaaggatcgcagtgacccagattatgatcgaaactacaaaaggtatgttaggagcccagttcctgacttcaacttgagcccaggtgccttcaactttgtgcctcagtttatgcagtatggcgttggttatgtgcaatctcctggcatgtctacaaaccagcctgctgtctactttggccagcctgatctaacaatggggtcttctggagctgctgtttacccacattggccaaccccagcaatgatgtatccccattgctatgacaatgttggttcaatgatttctcaggttcctctgtaccaatctttcaaccatggttag

SEQ ID NO: 217 - DNA, 1263 bp, Zea mays
atgatgacgcgacgcttggggcatagcatatggtattggagatgggctcccggacccgaaatccccgccgcacttaagtactacaatcccaggggccaggccaccggcatgttcgcttccatctgccggcggcggctcctccgcctctgccaaatccccttcggcaccggcgcaatccctagcgacgccctcccccactgccactccttagcaaccatcgcggacgctcccgtctccgagccctgtgctgcccttgtctcttgcgggctctcccccgccgccgcggtcgcccacaggctcccaatccgctccaccgccaaggccgacgccgtccgcgcgctcctccgcagctacggcttcaccgacgcggaggtcgccgacctagtccgccgattatcgcagatcctcagcgtcgaccccgaccggatccgccccaagcttgacctcttcgcctccctcggcgtcaagccgcggcggctcgccagatatcctgccctcctcacgcgcagcctcgacaagcacctcgtcccctgcatccagttcctccgcaacattctcagcaccgatgaggacgtctgcctcgccatctcgcgcaccccgcgcgccctctcggctggcctggagaagatcatgcggcccgccttggacaccctccgccgtcttgggctccccgacgagtctatctcgaagttagtagtcatcgagatgggcgtgctcatgatgtcgcccgaccgcatatgccagatcttcgaggccctcaaggagctcggcttgggcgtaacggagaagcgctttccttacggcatccgcgccttgtgctgcattagtagggagaagtggctgcatagggtggccctttaccggagcttcggggtgtccgagggtgagctgcagagagcgttcaagaaacagccgaatatagttaacttctctgatgagatcataaagaagaagatccggttcttcctggatgtgctgaaggttgaactaagcgaagtaatggagcaacctgcgattatagggtatagcttggagaggaacatcataccaaggtgtgccgtgctaagcttgttgatgagggagggaaagattgggcccaacgtcaagttgatttcggcattgcttggtagtgccaacatgttctccacaaggtatgtattgaggtatgccaatgagttgccagatgttgttaaggcatacgagggtaagatcacatttgatggcttcagggaacaggatcttttagttccactgaagctgtga

SEQ ID NO: 218 - DNA, 3051 bp, Zea mays
atggaggaactacggtgtctatctacagtcgctgaatctgatgacgctccagcagaacaggagtgcgaccacttctccctgaggggttatgttgctatgcttcagaagaaggatccaaaactttgctctcatattttccataaccagccacaatatgatgagcaccatgattcgtccccagttttggtgtcaaagtatcatcgatgggattgctcaagatgtcttgatagtgtggaagtttcaggccataggccaacatcggaaaatgtttctatgcagcagaatggaatgaatgatggctgctctatttcaattgttcggattttgcctaatagtgttgattccagaagactgttttcttgcacacagcaatcatctcaagggaatgatcgattgaccctttcaaagactgcccaagaatgcaattcaaaatgcagttctcctggcaacaaagcaattactgcgatgaatgttccagtagctgaagaaaatgttccagaggcactcgttgatacgagggttccatctatagaagttttacaggcctctcccaatagtattgatttgtcagcaaacatcttgaatgctgtctcgaagaatgtccgcgatttacctgatgatgttgaagaaaatggcacacagaatccacacagtctaaaaccttgtgtggcgccaaatgaagatgagaataacatagctaatgatgacctcaatgagcctaatgtttgtaaaccagtatctgggcacaaaagcaaacaagtctgcaacatgggtccacgccgagcatcgtcaaaaagaaatgttgaatctgatgatgccgttcaagtggaccatactaacagtgttgatctctgtgagggtggtaaaagaaaaatgcaccttgaggttggaaaaggtaatgacactactaatcagcaagtggacgaaatccagtcaagagctgtcaagaacaaggcaaaatacacaggagtagacaagttagaagatggatcctctctaatgaactggctgaaaagcactaataagaaagttagaacaaagaaaaaagactcagaacacaagaatcttgattcctcttctatttcaaggtcttacccagatatagttgcttctaatgatatgcatcatgattttctaccctcagttggggatgtgggccaggcaaatgtaccatctactaccagtgccaagcatgggaatggaaatgcacagaatgacaaactggagcaaaatatgcagaagatggatggcctgtgtgaaaatgaatctagaaacttgaaacagaggttcttctcaaatgaaaaatcaacgattttgctaaagagaaagctactgtccacttcggttgtccatgatgagaacattgagaacagtaatataaagagagatatgctcaggtcagatgatttgcctcaaatggaacctgaaggctctgtacagagatgtttggcaaaggtttctcttggtaaacaaaagatccagaatgtgtctggcctccacaagaagaatataccaaagaataagaaaggaaagcagaaggtgcacaagaaacagaatgtgatagacgacttccccatggacattgttgaacttctcgccagaaatcagcatgagagacagttgatgactgacaccaattctttggaaaactgtcatactcaacccaaggtagctcaagttgattgtgctgcatttgcagccaagggttgtcccaccaatgcatcaaatgagttcaacactaatttccaaaaatctttggcatcggaaagtaagcagaagtccttacaggatcaagcatcacccagtacagaggctgccaatgtgaatccgcaggatttacatactcagaagtcatcacagtgtcatgcagcatccagcaccagcaccgaggttccaaatggtcagcctccagaatcacaaatgcaaaattcgcttcaggttcatgtgttacccatcaaacggtctttcattgtgtacccttcaaaattacctgtccttgatgacattttggagtgtacccaagaacaacagacacaattccacagggatggaggggtcaccattgcatgtacctcacctatgttttcacatcatcaacatattgctgaagtgcctgctcggagctggaggaataacggggaaaagaagttaatgtgggattctttcaagacagcttcaagaaattcaccaacatcgtcatatggttttcaattcggaaacaggcttcaagaagttcattcatctcccagtcatgcttatggagcttctagtaactatgcagctcaccagccagtaattgtggctgtagatcagccgagaagtgttccaagcacaacatcgactatggaggctggtaggttgtatgatcgaaggattcctggacagtcaggcctctacccaaaagagcctatgcctgcaacacatcttctgagattgatggactcatcaacagctccagacttcacaaactatcaaagagctaacaggcgccagatggaacatcaaacacaaactctggattcacaatatacacagcatgatcagtataatgggtcactgagcacatcatatggaagacacataactggaaaggttccaccgacactgcaagacttatctcggcgtcaggtccagcaaaacctgcacaggcctttacgccctcatcctcgggtgggcgtgcttggttcgttgctgcagcaggatatcgcaaactggtatgaaaactgcgggccgccacagtctggatacaggctgggcgtttctaaagggacggcatcgcttgatatgaacagacatggaaactacgagaccttgaactcaggagtgttcacagcaggatggaatgcccttcaattgggttctgttagctctcttgccgatccagagtaccggttgccaaggtatggtacaggtcagccttgtacaggtggcaatgggagaacggttcacccgttggataagcttgtgcgaaaggatatctgtgtgactaacagaaacccagctgattttactgtaattagtgacatgaatgagtatatgagaagcctttga

SEQ ID NO: 219 - DNA, 684 bp, Zea mays
atggtattgttctttgactctggtgatggtgtgagccacactgtgcccatttacgaaggatatgcccttcctcatgccattcttcgtttggatcttgctggtcgggacctcacagactccctcatgaaaatcctgactgagaggggttactccttcacaacctctgccgagcgagaaattgtaagggacatcaaggagaagctggcatatatagcccttgactatgagcaagagttggaaactgccaagaacagctcctcagttgaaaagagctatgagctacctgatggccaagtaatcaccattggtgcagagagattcagatgccctgaggtcctcttccagccatccatgattggtatggaggctgccggaatccatgagacaacatacaattcaatcatgaagtgcgacgtggatatcaggaaggacctctacggcaacattgtgctcagtggaggttcgactatgttcccgggaatcgctgatcgtatgagcaaggagatcacttcccttgcaccaagcagcatgaagatcaaggtcgttgcaccgcctgagaggaagtatagtgtctggataggagggtccatcctagcctcgctgagcactttccaacagatgtggatatctaaggaggagtacgatgagtctggcccggcaattgttcacaggaagtgcttctag

SEQ ID NO: 220 - DNA, 789 bp, Zea mays
atgagggcggcgggccaggtgggcatccacgcgttggagaggagggcggctggcgcttgcacagttaatgatccagttgcactgaaacttttgagcaaggcaggtgagatgccatccctgacaccaccagatgatgagactataaggaccctctacattggcggactcgatagcagaataaccgagcaggatttgagggatcagttttatgcccatggtgagatcgagtccataaggatggtacttcaacgtgcaatcgcatttgtgacgtatactacaagagaaggcgcagagaaggctgcagaagagcttgctaataagctagtcatcaagggcgtgcgcctgaagctgatgtggggcaagcctcaggccccaaagcctgaggaggatgagtctgggaggctggggcaggtttcccacggagggctgctccctagggctgtcatatctcagcagcagagcggtgaccagcctcagccccccgggatggagggccaacagcaacaggctgcaccagcatcgtactacttcaacattccagcaccaccagcaacggagcggactgtgtatccatccatggatccacagaggatgggtgctatagtaaaaccacatgacagtgaaggcaaaccagggccgcagcaagccgggcaagctcaggcatcaagcaacccagcacaagggggcggctatcctgcaccaccgccatactaccatggtggagggcagcagcagccgcctgatggccctccagctcagcagcagccacagcagccaattcagaactga

SEQ ID NO: 221 - DNA, 2607 bp, Zea mays
atgggcactggagaggggtcgccgccggcgaggcggggcatcagcggtaggcgccgtcgatggccggacgaggacgacgacgagtatgtgctggaggaggaagaagaagaggattatgtggaggagctctccgcctcgagcgccggcgaggagggggtggattcagacgccgagtaccaggaggcagaggaggaggacgagatcgagaagccgcgcccaaagcgaccagcgaagggcatcacatcgagcgccggcgagaggggattggattcagacgccgaataccaggaggcagaggaggacgacgagatcgagccgccgcgcctgaagcgaccggccaagggcagcacatcgagcgcgggtgaggaggggttggattcagacgccgaataccaggaggcagaggaggacgagatggagacgccgcgcccaaagcgaccggcgaaggacagcacatcgagcgccggcgaggatgggttggattcagacgccgaataccaggaggcagaggaggaggacgacgacgaaatcgagacgccgcgcccgaagcgacgggcaaagggcagcaacagagtacggaaaggaaaggtggatctggccgccgcacgatctcgacgccggaagtatgaggaggacgaggactacgaggaggaggttgacgaagacgacgaggtggaggaggagtaccatgatgaccttgaggaggtcgaggaggaggaagaagtggcaccacagcggccgaagagcattgtgaaatgcggtgcccgtggccggaatgtgaagctgtctctggcagcgaagcgatctcatcagcggaagcaggaggatgatgaggatatggattttgacccagagttggatgacgaggaggtcgagatagatgaggatattgattttgatcccgatgtcgatggtgacgaggaggatgagtatcaagacgaggaggaagaggaactggttcctgcccgtgccagaaaggtaactgtaaagaatccggtgaagcgaaagtccatttcaaagaggcgaacaccaaagaagaagaagaaaaataggggatctaaggtttctaggcggaagggggcttcagctaaagtgaagaaatcagcacctgttaggaggcggagaaagcgttcagtgatagatgattacgaggatgaggatgtggatgatgacgatgacgacgacttcattgtcgacgatgaggtcattgtgaatcggcaccccaagaagaaggccaggatagggagtgggagggagacagtggtggaccctcaagtatctattgaggaagagacatggccagaccttgagtcagactcatcggactttgagtttgcgacgtccgatgaagaacctaacaatgttgaaacacctgtagctgagcagactacagtcagaaaagggaggaagaagaggatatctgagtcagagtcatcctcagattctgaatttgttgtatcaggtaaggaattggaagaattgagggagcctgagcctccaaaggctgcaccaaatctgcatgtgtccttgagaaggatttgtattacaaggcatggagaaggcaagggaaaggagaaacaggaacaggaggaggctgggaagccaatatgcgggatctgtctctcggaggagctgagagctactgtacaaggtgtcctcaattgttgctcacactatttttgcttcgcatgcatcatggaatggtctagggttgagtcgagatgcccattgtgcaagcagcggttcactacaatcaccaagtcatcaaaggtagatcttggtcttggagtgagaaaagctgtagtcaaggtcgaagagcgtgatcaggtttatcagcccactgaagaagaaataaggcgttggctagacccatatgaaaatgttgtttgtatagagtgcaatcaaggtggcgatgataatctcatgctactatgtgacatttgtgattcctcagcacatacttattgtgttggcttgggtagagaagtgcccgaaggaaactggtactgtggaggatgtagactcggtgacgagggaccatcatatactggaattcagcgtacagtagcttatgaaagacaaaattacagaagtcatgtcggtagttctgtaagttttggcatggctgtaccaggcggtacatttgaaaggccgtcatcaatcaatcctcgccattcttttcaagggattgatctaaatctatctccaagagagtttcccggagaatcacatcctgctgaatcacaagtttcaactgatagcgtatcaactcccactggaagagctggaagaactatttcaggaaggcgtgaattacaacggtacattcagagtttgttcagaccaagtctacctagtagaccagacacgtaccacaatattgcgcagaacagtggtggtgtatcaagaaatgaaccgaaccgctggaacttcccttcttcatcagaagcaaacacatcacagaatctgcctgatggcattcagaaccatcacagtgaccttccatttgttcaagctcacagcaattttgctccatttatgtccccagatggggatgatttccagcaaattgagggtgtcaagagcaacctcaggaacatgcagtag

SEQ ID NO: 222 - DNA, 2043 bp, Zea mays
atggttttccaaaagtggtcgtcgtcgtcagagatggagtcgtgcggtggaggccaagtcccggagatgccacgcgttcccaagtccgcgaggggcaagagatcggtcaggaagaaggaggcccagagcccggcccagatgtctgcaatcgaccttctcgcaaccgtggcagggaagctgtttgacgagggggcggggtcgctggggaacacgagcgccggtgccccggccttggctgcgttcgcaaaggatgccctggtgaagcaggagcagtgtgatgagcaaatgaagctgttcaagcatgaggcgacggatcaggatagctgcaatgagagtgcaatcctcccccacattgtgctccagcgggtggtgaataatgctaggaatgaggatcctaaggcgaagtctgaggtccaggacaaggaatcctccatgatcagctatacgaaggctgaattgggttgtaattttggtgtgatcgcagacaggtggtcgcctgaatccgtggaatcaggagccttcacaggagatgcagtggcgagactgatgatgacggccccggcaggatttcataagaatgcacccgaaatgtatagtttgcttgattcaatggatgtggatgtcaagccgcctcctttggtcagctctgacagcaccggcgagatgccattgcatggcgataaaattcaccgctcaacctccttaccgagggccccaaagggggtggggttttttgctgtagatagagatgatgacgacgacaagtcctctgggtgcactcatccgagcaccgccactaacaaggatttcacatccaattgtaaagctgagtataatagggtaaggaagctgctcactagtaagcacaggaaagttgctccagcgaggattcacaaatctgatctttcctatagtgatgtcgagcggaagccttctttccggtacaaaaaaatgcatacacgacagaggacacaaaggagtacattcaagcggaggaagctctttgatcgccatttagctctagcatctgaatttggtacagcaaatggaaagggaaacacaaaggttgccggaagaaactccaatgctgtgtctttggaagcaaacaaggggactaattcaatgccattccagaaatcttgtgggtcaaatgattgccatgtgaaacttagaattaagtcttttaacgtgcctgaacttcttgttgaaatcccagacagtgcaactgttggctcactaaagaaaactgttctcgaggcagtgactgcgattcttggaggtggcctacgtgttggtgttcttcaccatggaaagaaagtcagagatgatagtaaaacgttaattcaggctgggattggtcaggatgatatgctggacaaccttggcttttcacttgaacccaactgtactcaaaacccacaagtacaagctcctgaagatgtcagtttcctcgaaaacattgatactaccgaacccctcgcaaggatcacacctgctgactcgtcttctaagcttggtgaagttgacgtatcacaggagcttgcattaaccccattagcaatgaactaccagggcagtgatcatgattccgtgcactcccctggggctgtctcgtcgcgcgataaagactcgcgagccttatttctggttccagctgcagatcccaatgcaggagctgtagttccagcaaataagactaagaggtcaccagagcagggacaccgcagaatcaggcggccgttctctgttgctgaagtagaagcacttgtgctcgcagtcgaaaagcttggaaccggaaggtggcgagatgttaaacttcgcgcttttgacaatgcaaagcaccgtacctacgttgaccttaaggacaaatggaagacgctggtacacacagcgagcatctcgccgcagcagcggcgtggcgagccggtgcctcaggagctgctcgaccgggtcctggcggcccaggcctactggtcccagcagcaagccaagctccagcctaagacgccctcgctggctgaggctcgcttgctcacccaataa

SEQ ID NO: 223 - DNA, 1512 bp, Zea mays
atggcgtactcctcgcggacttgtggtcggtgcaacaaccacgagaggagatccggtttcatgaagtggctctgcaatttcctcaaggggccgaagcccggggagccgaaccgccggcggccccaggtgacggccggagaggaggaggacgcgctttggcaccaacgaccagttcgaccgaagaatgatccacctagaaatgacaacgaagaagtggaccgtgcaattgcagagtctctcacagaggacgtcagaacccccaaagagaaaacccgcaagggagacaaggacgacgaagatcttgcgagggccatacaggacagcctcaacatgaacccttacacgccttacaacccctatgctccctctcacgcccaacctagagggcacaggctgtgcgcaggctgcaagcatgagatagggcatggccattacttgagctgcatggggatttactggcaccctcagtgcttccgctgcaactcctgcggccaccctatccgtgagaccgagttcacattgctgagtacagatccataccacaagctgtgctacaaggagctgcaccatccgaaatgcgacgtctgccttcagtttattccaacgaacaggagtggcctgatagagtacagagcccacccgttctggggccagaagtattgcccttcgcatgagcacgacaggacgccacgttgctgcagctgtgagaaaatggagccaaggaacacaaagtacatgtcactgggagacggccgcagcctgtgcatggaatgcctggggtctgcggtcatggacaccggtgaatgccagcccctgtaccattctatcagagactactacgaggggatgaacatgaagctggaccagcagatacccatgctcttggttgagcggcaagcgcttaacgaagccatggaaggagagagtagaggcccacaccacatgcctgagacaaggggcctgtgtctgtcggaggagcagactgtgagcagtatacttaggaggcccaggattggtggaaaccggttactggacatgagaactcagccacaaaaactgactaggagatgtgaagttactgcaatacttgtcttgtatggcctccccaggctactaacaggatccatcctcgcccatgagctgatgcacgggtggttgcgcctcaaaggttaccgaaacctaaacgcggaggttgaagaaggaatatgccaggtcatgtcttacctgtggctggaatcagagattcttccgtcgtcctcaaggcacgcgcagccttcatcttcctacgcctcgtcctcctcttcgtcttactcttatccaccgacatcgtccaagaaaggtgggatatctcataccgaaaagaagctgggcgagttcttcatgcaccagattgcccatgacacgtcgacggcgtatggtgacggtttcagaactgcgtatgctgccgtcaacaagtatggccttcgccaaacactgaaccacatacgcctaacaggaggactcgctgtataa

SEQ ID NO: 224 - DNA, 2748 bp, Zea mays
atggatcccccgccgcggcggctagccgccccgctcctcctcctgctcctcgcagcggcctcccccgccgcgcgcgcgtggaagaaggacgagttccgcaactgcaaccagacgcccttctgcaagcgcgctcgaacccgcgccccgcactcgctcgaggcgccgctctccctcgccgctggctcgctcgccgtctcccccgacggctctatctctgccgagctctcccacccgtcccgcccgcgacccctcgtgctccgcctctccgtgctgcccccgcacgcgctgcggctccagatcgatgaggactactccaccgccactccgccgcaccgccggttccaagtccccgatgtcctcctcccggacctcgaggcacgcacgctccacctccccgagcccaagaccgccgccggcgtatccaccgtcgccctctcctccgaccttgacgtcgtcgttaagcacgatccgttcgagcttaccctccgtcgcgctgggtcgggcgatcctgtgctctccttcaactcccacggtctcttcgacttcgagccgatgcgggagtccaagccggagaacgagacgtgggaggagcacttccggagccacaccgacaagcgcccccgcggtccgcagtccatcaccttcgacctctccttttatggcgcggacttcgtctacggtctcccggagcacgggtccacctcgctcgccctccgccccacccgcggcccgggggtcgaggagtccgaaccctaccgcctcttcaacctagacgtcttcgagtacctccacgaatcgcccttcggtctgtatggctcgatccccttcatgattgggcatggaagtcggtcgtcgtctggctttttctggctcaacgcagcggagatgcagatcgacgtgcttgcaccaggttgggatggtgccactgcgcaggacaatgggcggatcgacacactgtggatggctgaggctggtgtcgttgatgcattcttctttgttggttctgagcccaaggatgtgatcaagcagtacataagtgtgtcaggcacaccttcaatgccacagcagtttgctatagcgtatcaccaatgccggtggaactaccgggatgaggcagatgttgacagtgtagatgctggttttgatgagcatgatattccatatgatgtgctctggctcgacattgagcacacagatggcaagcggtactttacatgggatcattctgccttccccaatccagaggagatgcagcggaagatagcagataaggggaggaagatggtcaccatcgtggatcctcatatcaagcgggacagttcattccacctccaccaggaggcaacagacaaggggtactatgtgaaagatgcaaatgggaatgactatgatgggtggtgctggcctggatcatcttcctatcctgacatgctgaatcctgagatacgcgagtggtgggctgacaagttctcctatgaaaattacaagggatcaactccaacactctacatttggaacgatatgaatgagccatctgtcttcaatggccctgaggtcaccatgcccagggatgcgatgcattatggagatgttgaacaccgagaattgcacaatgcatatgggtactacttccatatggctactgcagacggacttctcaagcgagacaaggggaaacatagaccctttgttttgtcaagggctttctttgctggaagtcaacggtatggtgcagtctggacaggcgacaactctgctgattgggatcacctgaaatcttctatcccaatggtcttaattcttggtcttactggtttgcctttctctggcgcggatgttggtggattttttggaaacccagaaccggacctgttggtgcgttggtatcaagtaggagccttttatcctttctttaggggtcacgctcaccatgacaccaagagacgtgagccatggttatttggggagcgaagaactgccataataagggaggcgattcatatgcggtattcactgttgccctacttctacacgctgtttagagaggctagtgtgaatggcattcctgtcatgcgtcctttatggttagaattccctgaagacaaagaaacatataacaatggtgaggcatttatggtcggaccaagccttttagctcaaggaatatatgaagagggccagaaatcagtgtcggtctaccttcctgggaaggagtcgtggtatgacttgagaaatggatctccatacaagggaagtgtgacacacaagctacaggttttagaagatagtattcccagcttccaaagggctggtacaattgtgccaagaaaggacagattcagacgcagttctactcagatggtgaatgatccatacactctggtgatagccctcaatagctctggtgctgcagaaggcgaactttatatggatgacggcaaaagctatgattaccagcaaggggcattcagccatcgccgatttgtctttgcagacaataagctaacttcattcaatatcgcacctgacaatttgagcaagaaatttacaagtggttgcgtgattgaaagaattatagtcctcggtttacgatccggagtgaagaaggctattattgagcctggaaaccaagaagtagaaattgaatcagggccaattagtttaaggagtggttccagcccagttgtgccaacaatccggaggcccaatgttcgcatcgcagacagttggacaatatggatagcgtaa

SEQ ID NO: 225 - DNA, 1644 bp, Zea mays
atggagctcgccaccgtcgccgctgcagtcgcctccgccgctgcgcgcccgcacgggcctttctcctctccccgcgcagtctctgcctccgtctcgtggaccagtctctcgctcgcctacacctcccgctgtctctcctccacgtcctcgcgacggcggctgcgctggctccccgtcacctcggccgccgtggagctccgcgaggccactgccgggggcggagactcgctccgtgtcaccaagacgccgcagcctggatccagtgttaagttcagcgtggaggtgcctacttccatcattcacgagtgctaccaatccacgctacaggagtacgccaaacgtgttaaggttcctggatttcggcctgggaagaccattccagaaaacgttcttataaactatgtaggaccgcaacatgtacaggatgccacgattgaagctatcttaaaacatacgcttcctcaagcactgtcctcggtagaggagagggcattagaagattctgttcgcattctgactcaatttgatgatatgagaaattctttctcactcgacaatgtgtttagatatgatgttgctgtggatgttgcccctgaagtccgatggttatctgaagacaaatataggaacctcaaagttgtcgttgaaatagatgaagctgttgatgcggaaaaggcggcagagaaagagcttcagcgtcgtcataaagctctaggcttacttagaattgtggctgacagaggcctccagattggtgatctggtggtgctggatatatttgcggaaagcattaacaatgatggctctagaggtgaaaaaatttcatcggctgagagtacaggtttccacttggacactgaggaaaatagtaaccttgttcctggatttcttggttcgttgattgggattcgtgctggtgagactagatcatttcctatccagttccccgagtcatttgagcgagaaagtctacgaggtgtccgtgcacagtttactgttgtgtgtaaagagctgttctacagagagttgccagtaatggatgactcacttgctgtaaagcttcttccaggatgcactacaatagacgaggttcgagagcgtattttgaaaagatgtaaagaagtggagaagacggccatagaacaagcaacagacaacgcgatccttgaccagctcgggaagttggtcgaggtcgacgtccctcgtgccttgtttcaagagcaagggcagcagctttatggagccaagcttctgcagcttcaggcggaaaggaagctggataaagaccagctagcttcgttatcaaccaagaggtcagtgcaggcgtacctagaagatgagaaggagaacattacaagaatcattaaacagatgctggccgttggcgatattttcaaatccgagaacttacagtactcgactgatcagctcgtcaaggaagttgagaactccatagcggagttcaaacagtacaaccaagactatgatgaggacaacatcaggcagcaggtctggctgtttctggttgtgacctcctccactaaactacagcctagctctgttctcacactcatgcgtatgtatttctacgcgcgattcaatgatgcaggtccaggatgtcctagaggcggcgaaggtgcttga

SEQ ID NO: 226 - DNA, 945 bp, Zea mays
atggcagctgactccagcatggggtttcaccaggggatcaccgcctctctgtacaaccatcacatgctctcgttccagtccaacagcgacgtcggcatcggcggcggcgacgacgctaccggtggcatggtcatggccccggggagtgtgagtgggggcagtggcaacgccgggctgttcctctccccaaacacaggggtcgtcggcaacgcaccgggggttgccccgttaatgaactcgtcgggggatgcgttccgtggcactgggacgcccaagtataagtatgtcactggttctccttccgattggagtgaccgtgaggtagacatactgaatgaagggcttgtgagatatgctcgtgaacctagtatcatgaggtacattaagatagcagctatgcttcctaacagaaccatcagggatgttgcgctgcgatgctgctgggctacacagggtaaagagagaaggaagaaacctgatggattctacacagggaaaaaaatgagagacgtgaagccaatccaggacaaaatggttgcatcagtcccaatagctaattttcacatgacacctacaaccaatgtaatccccttttcggtatcaacgcagcatccaaatcaacaaagtcaggttcccaaagaagctcctgttgtcgacagtgcaacccagcgtctcctggaggaaaataatcagttgcttaaccagatttctgcaaataatgaaacattcaagacagtggagaacacagatctttttctccgcacgagtaacaacatcaaaacaattttaagcagaatgagcgaaacgcctggtatcatgagtcagatgcccccattgcctttatccataaacgaagaccatataaattctcttattcaactgaacagactggttgcatcatatggcacaacaagcatttcccatcatacgaagcaagagccatga

SEQ ID NO: 227 - DNA, 912 bp, Zea mays
atgagagagatcctccacatccagggcgggcagtgcggtaaccagatcggggccaagttctgggaggtgatatgcgacgagcacggcatcgaccacaccggaaagtacgccggcgactccgacctccagctcgagcgcatcaacgtctactacaacgaggccagcggcggccgcttcgtcccgcgcgccgtcctcatggacctcgagcccggcaccatggactccgtgcgctcgggccccttcggccagatcttccgccccgacaatttcgtcttcggccagtccggcgccggcaacaactgggccaagggacactacaccgagggcgccgagctcatcgactccgtgctcgacgtcgtgcgcaaggaggccgagaactgcgactgcctccaagggttccaggtctgccactcgctgggaggaggtacaggttcaggaatgggcaccctgctcatctccaagatcagggaggagtacccggaccggatgatgttgacattctctgtcttcccgtcgcccaaggtgtctgatactgttgtggagccctacaacgccacgctctccgttcaccagctcgttgagaacgcagacgagtgcatggtgctcgacaacgaggctctctatgacatctgcttccgcacgctcaagcttgccacaccaacctttggtgatctcaaccaccttatctctgcaaccatgagtggtgttacgtgctgccttcgcttccctggtcagctgaattctgacctccggaagcttgcagtgaaccctgatccccttcccacgtctgcacttcttcatggttggatttgctccactgacctcgcggggctcccagcagtaccgcgctctcaccgtgccagagctgacccagcagatgtgggactccaagaacatgatgtgtgctgctga

SEQ ID NO: 228 - DNA, 267 bp, Zea mays
atgatttgtttggcttcatggattaacaaacaggtggctagcatccttgaagatgataagaagggtgtattaaggcccccatctgattcgacgaagcatggaagggcaggactccttgagatcctagagcgaaagaatgtccgctttgtgccattcagtggctgggagaagattaattccgtggaaaagatggcaggggagctgagaaataaacctagagagaagatcacaacctgggatgggctccagaaagttgcacacgagtaa

SEQ ID NO: 229 - DNA, 2562 bp, Zea mays
atggggaagaggagcggcagcagtaggaaggacaagaacaaggtcattctcccaccggagctgccgccggaaatacacgacgatgaggtggatgtcagcgaggaagacatcgagttctatgccaccgacagcagtaacgttacacccttccgccacttcgacaagaagtccatcgacaggtatgtcgggagggttgccgggcgcgacgagggcgaggtcgagcgcctctacgaagagcgccagaagcggaaggccacagaatcgtcggggagaccccgcgaggatgatgattatttggaggtcgaccccgtcgacgcactccccaccaagacgctgcaaggggagctcgtctacaatagagctaagaaagcaaggtctgaagacaattccggcagtgttaagactaaagctcaagagaatggtgcaaatgccaagacaaatactaaaaaagatgaatcaaagggaaaatctaaaaacaaaaagggagatgataataaagtgaaaaatattcaatcccaaactgaagttccaaagggacaactacactcaaatgtgctggaggaagtgaaggaggaactttcagctgaggaattattcgaaaaaaagaaggctcaacttgctgaactggggatgtctatgcttgaagatcctgagtcgaacattagatctctgaatgatatgctaagtataagcaatgacagagaccaaaaggttgttaaacttggtgtgatgtctttgcttgctgtgtttaaggacgttattccaagttatcggattaggcagctgacagaaaaggagctagcagtagaagtttcgaaagaagtgaagaagacaagatattatgagtacacacttattcgctgctacaaggcctacctgcagaaattgatatcgttggagaagcagccctacttttatactgtggctgttcgttgcatgtgtgctttattagacactgccccacattttaacttccgtgaaagcctattggctagtgtggtaaaaaatttaagctcctcagatgatgtagtaaggaaaatgtgttgtgaagcaataagatcattatttataaatgaaggaaaacatcgtggtgaggcaacaatagaagcagttaggttgattgcagatcatgtgaagctcaatgattgccaacttcatcctgatagcattgaggtcttcctgtctttgagatttgatgaagatattggaaaagatgagattcaggaggaaaaggtgaaaccaaagaggaataaacgttggcaaaaaaatcaggaggttccgaagcaattgccagttaatgataagaagaaaaccagacaggaactgatctcaaaagctagaaaggaggttgatgcagaccttagagcagtttccttcactcttgacccgaaggagagaaaagggatacaaaaagaaacactttctgctctgtttgagacttacttccgcattctgaagcatagtatggccgcttcaaattcaaggactaaggtgaataatgtttcccctggtggctcacacccacttctcactccatgcctggagggtttagggaaattttcacatttaattgatttggatttcatgggtgaacttatatcttgcctcaagaagctttctgggtatagtgaccgacaagacgaaattcccaatgataatgcactgtctgtctcagaacgtctgcagtgctgcatagttgtgtttaaagtctggaggagcaaccttgaggcactgaatgtggatctgcaggatttctttgtgcagctctataacctcatactggagtatcggcctgacagggatcatggcgaggtattggctgatgcgctgaagacacttctttgggaaggcagacagcatgatatgctaagagccgctgctttcatcaaacgattagccacatttgctctctcatttggctctgcagaagcaatagcagcattggtcacactgaagcatctcctccaaaaaaacagcaagtgccgcaatatgttggaaaatgattctggtggcggttctctgtcttgcttagttgcgaaatacaaccccgaagctacggatccatatctgagtggtgcactcgcttcagtcctctgggagctcagcctcctagagaagcattatgacatctcagtttcctcgatggcttcgaatatcttgagtatggcaaacctgaatcccacccagaacccagttcctatcttgaacgtgaaccctcttgaagcgtacagagacctgtcattggaaagggaactatcaaaaccggctagcaaagcattgccactgaacctcaaaaggaagcggcgtgccaaggagtttgttgcgctaagcccagatgtgcttcagaaggcagattgctcggtggacaaagacgagctcgaagagaagctgcagagccatttctccgtgctaagaggcatctctgagaatgagaggttgagggcagagctgaaccacacactgtcatccataaacatgtacaaggagtacaagaagcagaaaaggaaaaacatgaaagttaagaccggaaggaaaaaaaacagcaaggctttagccgtttaa

SEQ ID NO: 230 - DNA, 4923 bp, Zea mays
atgcatgggtggcgcggcgctgaggggtgcgacgtcaggaggcggcgtctcgttcggctcatgtggccagcggcacgcgtagaggcagaagctccaccaccaccggcacaaggaccagctacttctccttctggttcatctgctacccatcctcggactacttatcggccggaatcgagtgcgcagaagcaggagtgcatcgatcttccctgcccagtgtcatctgattcctttgtaaaggacgggcgtgagattagagttggcgattgtgctctttttcgggctgtcgatgtccctccattcattggattgatacgttggattgagaagaaggaagaaggctatcccaaattacgtgttagttggctttatagacctaacgacgtgaagcttaacaagggtatacaactcaacgctgcaccaaacgagatcttctactctttccaccaggacgaagcatctgctgtttctctgctgcatccttgcaaagttgcctttttacggaaaggtgttgagctaccagctggaattgcttcatttgtatgttggcgcgtgtacgatattgacaacaagtgcttatggtggcttactgaccgggactatattaatgaacggcaggaagaagtaaatcgccttctatacagaacaaggctagaaatgcgtgccgcattacaatcaggtggacgctctccaaagcgcttaaatagtccttcagcttcccagcaactgaagactgcttcagatggtacacagaatggtggtttgtctagaggaaagaagagagagagaagtgaacagggagttgatccagccaagcgggatcgtgatcgtctacttaaggttgatgacggtgagcctggaagctttaacttggatgatattaagtccgaaatagcaaagataacagaaaaaggtggacttccaaatgcagaagcagttgcaaaacttgtacatcttatgcaacttgatcgaactgagcagaagatagaccatagtggtcgggttatacttgctgatgttattgctgctacagatagtcccgattgcctcggcagatttgtccaatcaaggggccttcccgtgttggacagttggcttcaagaggcccacaaagggaagtctggtgatgggagtagtcctaaagaagcagataagcctattgatgaacttctcttggccctgcttcgtgcactagctaaattgcctattaatctcagtgcattacaaagttgtagcattgggaaatctgtcaatcatctgcgcagccataaaaatctggagattcaaaagaaagctaagtgtcttgttgagaactggaagaagcgtgttgatgctgagatgaagtcaaatgatgtgaagcctttagtttcaggtcaatctgtttcctggtcaggaaaagcaggttttcaagaaatttcaaatgttggaaccaaacgaggtggctcaagtgagaacagtccaaaaaattcagtgcccactctttcatcatcaaaagttttgactgataaacctgggggcacagatgctgcagcgaagttgaatcctggggtatctgcattgtcaaatttacaacatgtgcaatcaacacatgttactaccaacttgaaggagcagccctgcaaatcaactggtgggactggctgtcctgagctgcctactgtaaaagaggagaaaagcagcagttcaagccaatcgccgaacaacagccagtcaatatctagtgagccatcgaaggatgcaagaagttcaactgctgcttctggtggtgctagtaaaacttctggaagctcttcacggagccatcgaagggcaaacaatggtcttgtttcagggaacctgaaggaaccttctgtaggaagatctgtctcccttgatcgatcattgctgcaggataagtcatcccaaactggtacagcttctgaaaaaggaattgatatgccatctgatcatggaaataatcatagattgattgttcgctttccaaatcctggtcgtagtcctgctagaagtgcaagtgctggatcttttgatgacccatctgttactgggggtagagcttcatctcctgtggttgcagataggcatgatcagactgagcgcagggtgaaagtgaagactgaaaattctcggcctcatttagcatctgatgctaatgcagagtcctggcacagcaacgacattaaaggagctactggttcggaggaaggtgataaatcaccatgtgctatattagatgatgacaacagcaggacacctgatcattctgttaaggatgcacatgcatcgcgagctgcgtgctcgtcatatatgaatgaaaaaggtgtcagtgaaactaaggtgggaacctcattcagcccaatgaatgctcttattgaaatcaagtactctgaagctagtcattcactgcaagctggagatgacacagctatgaatcttcttgctagtgtggcaggagaaatatctaaatctgaattggcttcttcaccaagtacttctgtaaagaaattggtctgtgagggtgtcaatactggaaaggttaaagtagaaagtgacatgggcccatcacatccagggcaagcagatgctaagaaagttgccatggggaatgaagtgaaaaatgatgcttgtttggttccgaaggaggaacaacatcaaactgcgccatctcctgagctagcagattcaaaagcagttaaatcttcagcaaagattgaaatccatgaagggcatgcaaacaaatgcaactcccagcatgcttcaattgattccaaaggtgaacatgatcagaacttcaatttgtgccactcagctaacacaaacgttgtcaatatttctaatatgtattcatctgcaggcgaaaatcgggatggctgtactgcccatgggaaagttgaagatggcagtacaaacaaggatggtgccatggaatctgcattcggcagccagcgtagcttggttgtttccagtaaaaattcaagattggttcttgctggggaatcttcattgtctgctgctgataaacaaacacagggtctgttaaaatcaactaatcataagcatcttctgagtgtatcggacaacccaggagcctttgatagacatgacagtatggctggaaaattagatttgatggctgcagaggtgaaaaaagctgatgtcgtgggcaatagtagtgtattgcagaatgacactgaaaagaaggaacatgtttctccctcttcggctgatgttccaaaactagtaccagcagcgtccccagttggtgtggcaaatgggaataatgagatgaaagaatcaaacggcagttcaagtgaatccaatagccatgtaaaatctgaaggtgtcaattctcagcaaagcgagcaaagtgcaaagcagagttcaaagaaatccagtgatggtgtgtgcggaaaagaagaccatgtcttatcagacgaagaaggttcttctctagccgctcacaccaagtcaaatgctacagccaagcttgattttgacttgaatgaaggaatacctggggatgatgggcatcagtctgagacaactgcctcacctgttgtatgttcctcagcaatccatttaactgggcttttgccattcacttcgcctactacaagtgggttgccgccagctccaataacagtagctgctccagctaaaggaccctttgttcctcctgaaaacctactaagagcaaagccagagatcgggtggaaaggttcagcagctacgagtgcatttcgccctgctgaaccaaggaagattttggagatgcctgctgccacacgtgacattccagtatctcatgctgctgggaagcagtctcgtcccacgcttggtttcgatttgaatgttgcagatgaccaagctctcgaggaagattttccacagagttctgcacagactacctgttcagaatctggaaatacgagaagtcgagatggctcgtcacgaagtgctggtattgaacttgatctgaacagagctgatgaagttgcagacaatggccaatttgtaccaaatgcttcacacagagttgaagtcccattgttttcgacgagatcgttacctagagttttatctaatgctggcgcaaatagctcaagggactttgatcttaatagtggacccgacctttatgatgttggcactgaacctgcaccaaggagcctaccttctaaaaatacaagcagtattcaattcctaccacaagttcctgttaggatgaatagtgatgccatgagtaataatatatcaccatggcttgtctctaccagtccttgtggtccagtagctatacagtcttttttaccatctagagaacagccttacccattggaggcagcacctggagcccagcggattattgcgcctacagctgatggtggccaatttggaggtgatccctgcaggcctccagttatttcaacgtctccagcgatggtttttcatccgcctgcatatcagtatgcaggattctctttccctccaagtgttcaccttcaaacaccagcattttcaattggatcagcaacatttaataattctgcatctgcaggagttccatattttccaactctttcctcctctcttgttgggccagccggagcgttgccttcccaacattcaaggcagtatgccataaatcttgctgagggtagcagcagtagtgtacgtgacggtaatcggaaatgggaaagtcagggccttgatcttaactcaggccctggaagtatagatttagaaggaaaggatgaacggatgcctttaccagtcagacaaaatttgatcccacccctacatggctttgtggaggatcaaggaagaatttaccaaatgccagttgtaggaacaaagagaaaggaacctgatggcagttgggactcagaaaggtctacatacaagcagttaccatggcaatga

SEQ ID NO: 231 - DNA, 5775 bp, Zea mays
atggcgtcgtccacgtccaggcgccggaggggtgggggcctcgagcgggtggcggacaactgggagcgcctcgtgcgggccgcgctcaagcgggaccgggaccacctccgcgtggggggagccccggctgccgtgggagggcagaggcttgccgacgccgtgccggcctcgctgggtcggaccaccaacatagagcagatcctgcaggccgccgacgacatcgaggtcgaggaccccaacgtcgcgcggatcctttgtgaacaagcgtacacgatggcccagaatctggatcccagcagtgaaggtagaggggttcttcagttcaagacaggtttggcatctgtaattaagcaaaaacttgctaagaaggatggggctccgatagaccgacagaatgacgttcaagtcctgtggaacttttatcttgaatacaagagtcgttgtcgggttgatgatatgcaacgtgagcaggagagactgagagagtcaggaacctttagtacagagatgggaaatagggcaatgaaaatgaagaaagtttttgctacattgagggctttgcttgatgttctggaaaatcttgttggtcagtcaccaactgatagacttcatagacaaattctggaggagataaagagaataaaaagatctgatgcagccttgagaggtgaacttatgccatacaacattgtaccccttgatacatcatcgtcagtggcaaatatttttgggtttttccctgaggtcattgctgcaacagcagcaattcagaactgtgaggacctgccacgattcccttttgatacaccccagctaagacaaaaagacattttcgaccttttgcaatatgtttttggcttccaggaagataatattcggaaccagcgtgaaaatgttgtacttatgttagccaatgctcagtcccggttaagcctgcaaattgggtcagaacccaaaattgatgagatggctgttactgatgttttttgcaaagtcctggacaactacataaaatggtgtaggtacttgggcaggcgtgttgcatggaccagccttgaagcagtaaataagaaccggaaaatcatattggttgccctctactttctgatttggggtgaagcagcgaatattcgttttctcccagaatgcatatgctatattttccacaatatggcaaaggaactcgatgggattcttgattcatctgttgctgagactgcaaagagttgcactactgagggttccacttcatttcttgagaaaataattacaccaatttatgataccatggcagcggaggctgaaaataataaagatggaaaagctgcacattctgcttggaggaattatgatgacttcaatgaatatttctggtcacgctcatgctttgagcttggttggccacctgcagagggttccaaatttttgcgcaagcctgctaagaggaaacgtacaggaaagaccaattttgttgaacatcgcacttttctgcatttgtaccgcagtttccaccgcttgtggatttttctgctattaatgttccagctcttagctattattgcctttcaccatgggaagatggacattgacaccattagaatactacttagcgctgggccagccttttttgtactaaacttcattgaatgctgcttggatgtcatactcatgtttggtgcatataagacggcaagaggttttgctatctcaagattagttattcgatttctttggttaactgcagtttcaacatttgtaacctatctctatgtgaaagtcctggaagagagagacacaaggaattcagattcgacttatttccgaatttatggtcttgttcttggtggttatgctgctgttcgaatcatgtttgcactgatggctaagatcccagcttgtcataggctctcaagtttttctgatcggtctcagtttttccaatttttcaagtggatataccaggagcgatattatgttgggcggggactttatgagagtattagtgattatgccagatacgtgatattttgggtcgtcatactggcatgcaaatttacttttgcatattttctccagattaggcctttagttgaaccaaccaatattattgtgcaactccatgatttgaagtattcctggcatgatcttgtatcaagggggaataaaaatgctttgaccattctgagcctatgggcaccagtcttagctatatacctgatggacatccacatttggtacactcttttatcagcacttgttggtggcgttatgggtgccagagatcgccttggagagattcggtcaattgaaatgcttcataaacgttttgagagctttccagaagcgtttgctaaaaacctttccgcttcaaggttcttaaccctattctcaatatttgaatcagaaattacaactaagacgtatgcctcaatattttccccattttggaatgaaattatcaagagcttgcgtgaagaggactatatcagcaacaggttattgggtgaatttctttccagggaaatggatctgcttatgatgccaagtaactgtggaaatttaatgcttgtacagtggccactgtttctattgactagcaagatcatgttggcaaatgactatgcttctgactgtaaagactcgcagtatgagctatgggatagaatatcaaaagatgaatacatggcttatgccgtcaaagaatgttactacagcactgaaaaaattcttcactctttagttgatgctgaagggcagcactgggttgtaaggcttttccgagatcttaatgacagtatagcacagggttcacttttagtgactataaatctgaagaagttgcagttagtccagtctagattgacgggcttgaccggtcttctgatacgcgatgagactgctggccgtgcagctggtgttactaaagctcttcttgagctttatgaggttgttacccatgaatttctttcacagaatctgagggaacagtttgacacgtggcaactgttgttaagagccagaaatgatggacgcctattctctaagattttgtggccaaaggatccagaaatgaaagagcaacttaagcgattacacttacttcttactgtcaaggacagtgccaccaacataccaaaaaatcttgaagctcggagaagattacaatttttcactaattctctattcatggacattccacaagcaaagcctgtatctgagatgatcccttttagtgtctttaccccatactacagtgaaacagttctttatagcatgtctgagctttgtgttgagaatgaagatggcatttctatacttttctaccttcagaaaatataccctgatgagtgggctaacttcttagaacgaattggctgtggtgaatcatcagaagatgattttaaagaaagtccaagtgacaccatggaactccggttttgggtatcttatcgtggccaaactttggccaggacagtgcgtggaatgatgtactatagaagagctttgatgttacaaagttacctggagaggagatgccttgggggtattgaagatggaaattctgcagcagaatatattgacactcaaggctatgagttatctcctgatgcacgggcccaagcagatataaaatttacttatgttgtttcttgccaaatatatggactacagaagcaaacaaaaaaacaagaggctgcagatattgctctcctactgcaaagaaatgaggctcttcgggttgctttcatacacgaagaggaaatcatatcaagggatggtaaggctacaacaagagagtattattccaagcttgtgaaggctgatgttcatggcaaagaccaagaaatatactgcattaaattgcctgggaaccccaagcttggtgaaggcaaacctgagaaccaaaaccatgccataatcttcactcgaggagatgcagttcagacgatcgatatgaatcaggataactacttggaggaagcaatgaaaatgagaaatttacttgaagaatttcataatgctcatggaaaacatggcatacggaagcccacaatcctaggtgtgagggagcatgtattcacggggagtgtctcttcgctggcgtcatttatgtcgaaacaggagactagttttgttactttggggcaacgtgttcttgcttacctcaaagttcgaatgcactatggacatcctgatgtttttgatcggatatttcacataacccgaggtggcattagcaaggcgtctcgagtgattaatataagcgaagatatatatgccgggttcaattcgactttgcgccaagggaacatcacacaccatgaatatatccaggtggggaaagggcgtgatgttggcttgaaccaaattgcactatttgaggggaaagttgctggaggcaatggtgagcaagttctcagccgagatgtgtaccgtctgggccagttatttgatttcttcaggatgctaaccttctttttcaccactgttggttattatgtctgcacgatgatgactgttctaactgtgtatatcttcttgtatggaagggtttatctggcactctctggccttgactactcaatatctcgccaagctaggtttttggggaacactgcactagatgcagctttgaatgctcaatttttggtccagattggtatttttacagcagtgccgatgataatgggtttcattctggagctggggctgatgaaggctgtttttagttttattacaatgcagctccagttctgttcggtgtttttcaccttttcgcttggaacaaggacacattactttggtagaacaatccttcatggcggtgcaaagtatcgtgctactggaagaggttttgttgttcggcacataaagtttgctgaaaattataggctctattctcgaagtcactttgtcaaagcgcttgaggttgctctcctcctgatcgtttacattgcatatggatacacaaaaggcggttcatcttcatttattctgattactatcagtagttggttcctcgttatgtcctggcttttcgcgccttacattttcaacccttctggtttcgagtggcaaaagactgttgaggactttgatgactggacaaactggttactttataaaggtggagttggtgtaaagggcgacaacagttgggaatcttggtgggatgaggagcaggcgcatatccagacattcagaggacgtattcttgagacaatcctcagccttagatttctcatgtttcagtatggcattgtgtacaagcttaaaattacagatcataatacttctcttgcagtttacggcttctcatggattgtactctttgttatggttcttcttttcaagctttttactgcaactcctaggaagtcgacagccttgccgacttttgttaggtttctgcagggcgtccttgctattgggataattgcaggaattgcccttcttatcgtgctcacatcattcactgttgctgatttatttgcaagtgcacttgcttttatagcaaccggctggtgtgtcttgtgtctggccgtaacatggaagagggtagtgaaagtccttgggctatgggattcagtccgtgagattgcaaggatgtacgatgcaggaatgggagccatcatctttgtgcccatcgtcgtcttctcatggttccccttcgtgtcaacattccagtcacgtttcctcttcaatcaagcgtttagtcgaggtctggagatctccctcatccttgcagggaacaaggcgaatcagcagatttga

SEQ ID NO: 232 - DNA, 861 bp, Zea mays
atggaggagtacctggagagcatgaaatctctccgctcctacatgaacgatctggaggacgacgccgcgaagcggtctgtcgaggagcagcagcagcgtacagccatcgacgctcacgacagcgatgtcgcgctagtgatggcgcaagcaaagcaggcgagcgaggaggccgagcggctggccacagcgagggctaaggtaggcatgcagatggccgagaagcagggaaggattgccacgctggacatcgagtgcgccacactgaagcagaccttggagctcctccgtcaggaaactgcaagtacatttgtgaaactctgtgagaaaagattgttctacacaaagagaacagaaaccttgactgtcaaactacaggagcaacaggaatggtttagtatgaagaataagattactagacaggagccacatgttgccaaatctcagagcaagcaaaacttcattgaaggggagaaacatgtcatatttaactcagaagggagcctggataagtttaacaagcccgggaaactctacacacaactggtgtcagctcagctcaagatccaagacatcaaatcacaaagatcagcgcttcttttagaaatcagcagaatcaagcagattctggagcaagagaaaaacataattcctggttttcccgctgcactacagcagatggatatgaagtcattggaggaggaatacaaagctctgcaaggtgataaatcgggggaagttgagtacttccagtctcttgatgaaacaattaatgggatgaaggggattttggatcctgtcaaatgccaatgtggactggagtacaacttaaaacttgatggtgaagccatggatataagctaa

SEQ ID NO: 233 - DNA, 1308 bp, Zea mays
atgggcctttcaacagtttactccccggccggaccgcgcctcgtgccggcccctctcggccgctgccgctctgcccagccccgccgcccgcgccgagccccgctcgccaccgtccggtgctccgtcgacgccaccaagcaggcgcaggatggcgtggcgacggcggtcgcgacggaggcgccggcgtcgcggaaggagtgcttcggggtcttctgcaccacctacgacctcaaggcggaggacaagaccaagtcgtggaagaagctagtgaatgttgctgtgtcaggcgcggccgggatgatatcaaatcacctgctgttcaaactcgcttctggtgaggttttcggacaagaccaaccaatagcacttaagctactcggctcagaaagatcgtttcaagccctcgaaggtgtagctatggaactggaggactcgctgtatccactgctgagggaagtcagcattggcatagatccttacgtggtctttcaagatgtagattgggcccttcttattggcgctaagccccgaggtcccggcatggagcgagctgcgctactggatatcaatggccaaatctttgctgaccaggggaaagcacttaatgcggtcgcctcgcggaacgcgaaagtcttagttgtcggaaatccctgtaacactaatgcgctgatttgtttgaaaaatgccccaaacataccggcaaaaaactttcatgcattgacgaggttggatgaaaatagagcaaagtgccagctggcactaaaagcaggtgtattttatgacaaagtatcaaacgtgactatttgggggaaccattcgacgactcaggttcctgatttcttgaatgccaaaattgatggaagaccagtgaaagaagtcattaaggataccaagtggttagaggaagagttcaccctcacagttcaaaaggtatgtgcctctccctgtttgcaatatgtttggtgttgcctgtcactcgagaaattaagtcaagactgcaccataatttattctgttcatatatctaaacagcgtggaggtgtgctcatccaaaaatggggcagatcatcagctgcatcgaccgctgtttcgatagtggatgctattagatccctcgtaactcctaccccagaaggtgactggttttctacaggggtaagttttgaggcctttgaaccgatcaaatctttgtttcggcattcctctaatggaaaaggcgataaaaaaaatacaggtttatacgactggaaatccttatggcatagcagaggatatcgtgttcagcatgccatgcagatcgaagggtga

SEQ ID NO: 234 - DNA, 582 bp, Zea mays
atggccaccgacgaagccaccaagccgtccccgatcccaccctatcccgagatgatcctggcggcgatcgagggtctagacgacaagagcgggtcgaacaagtccgccatctccaagtacatcgagggcaagtacggctcgctgccccccgcgcacgcgtcgctgctgaccgcgcacctggcgcgcatgaaggagtccggagagctcgtcttcctcaagaacaactacttccgcgcgggcgcccccgacgcgccgccgaagcgcgggcgcgggcgccctcccaaggcgcgggacccgaacgcgccggcgccggcgcccaagtcgccgtcgtccacggggcgcggccgcgggcgcccgcccaaggccaagagcccgctggaagccgccgtgaagcaggccaccgcggggatgcccaagccccgcggccgcccgcccaagaaggccaagaccgacggcgccgcgtccccgtccccgtcccctgcccctgcccctgctggcgacgggtccacccccggcaagcgcggccgcggcaggccccccaaggtacgccccgccgtgcccagcgagacggccgcggcttga

SEQ ID NO: 235 - DNA, 456 bp, Zea mays
atgtcggagacagcggggcagtcgttacaccattcgtgcagtcgttacaccattcgtgcaggtcgctacttatgcgacaaggaatttcgctacgttaggacagttagagttactgccgccgtttaccggggcttccattcaaagcttatcacacttctccttccgaccttccagcaccgggcaggtgtcagactctatacatcgtgttaccacttagcagagtcctgtgtttttaataaacagtcgctaccccctggtatgtgccgctttcctaatcaaaagataggagagcaccccttctcccgaagttacggggtcattttgccgagttccttcgacatggttctctcgacgcgccctagtatactctacttgttcacctgtgtcggtttggggtacggtcagttcaccgggaggatcgccctcccaattcgaagttttttcctggaagtttaa

SEQ ID NO: 236 - DNA, 3012 bp, Zea mays
atggccatcccggaggacctagaggggacctcgggcgatggcggggtgacgaatcgcgggagtagagggcggcgaaaaggcgcggcgaaggggcgcgggaggggcaggccgcggagcgccgacagatcctttccgccgccggcgatggctggggtggcggtcggggacagggtgctcagggagaggaggcacacgaccaacgttttctgcgagcgcgacacggatgttgacgatgagtccatttattttcaggatgatgttgagacagttaggtccaaggactcaaggagtggcgatgttttacagactgcaaaaaagaggaagaagggaggtgcagggaaggtttctgtcacaaaaaggtcgaaaagagagggtgaagaacaaaagaaggcatcaccctccaaggataaagattgtgctgaaactaatgggaaaaggaagatgttgactggggataatgccctgatgtgccaccagtgccagaggaatgataaagggagggtggtctggtgtaattcatgcagaaataagcgcttctgtgtgccatgcattgaaagatggtatcctaacttgtcagaagacgaatttgctgcaaaatgcccatattgtcgcaagaactgtaattgcaaaggatgccttagaatgagaggggttgaagagcctccaaagaaggaaatttctgaagaaaatcaaatctcttatgcttgcaatgttgtgcgcttgttgcttccctggttgagaaaactgcgacaggagcagatggaggagaagaaattggaggctaaaataaaaggtgttttggtgaatgagatgaagttggaacaagctgaatataatctagatgagcgtgtctactgcaataattgcaaaacttctatagttgattttcacagaagctgcaagtactgcttttatgatctgtgccttgactgctgtgtggagatccgcagaggtgagattcctggaggagaagagataatgagagtaaagcctgaagatagaggccgagcatatctttttggtactactaactcaaaggatgggagtaaaaggttctccatgaggaggcacagctcatccctggagaatgagccttccaatgtagtaggttctagtgagggggcaaataactctctggagctgtggaaagcagaaagtgatggtagcataccttgcccaccaaaggagctaggaggctgtggcggttcgattttggatctcaagtgtttttttccagaaaagatgctttcaaatttagaagaacgagctgacagaattatgaggagcgaagtatttgcaaaagcagtagccaaaagaagtgaccagtgcccttgttatgaccattcaggaaacataagaactcaggacgtgcgagagactgcaaatacgaaaggctcaagtgataaccatctctactgcccagttgccactgctatcaaggaggatgacttggcgcactttcagatgcactggacaaaaggcgaaccagttattgtttctgatgttctgcatttgacttctggtctaagttgggaaccattagttatgtggcgggcattgcgagagaaaaagactaatggtgacgtagaagatgagcactttgctgtcagggcattagattgccttgattggtgtgaggtggaaattaacatacacatgttttttgtgggatatatgaaaggcagaacgcatcacatgacacactggcctgagatgcttaagctaaaggactggccgccatctagttcttttgatcagagattgcctcgccatggtgctgagtttatcagtgcattgccatttcctgagtacactgatcctcgatatggtccgctgaatcttacagtcaagctacctgatggtgcattgaagccagatcttggaccaaaaacttacatcgcttatggattttaccaagagttaggcaggggtgattctgtgaccaagcttcactgtgacatgtctgatgcggtaaatatattgacacacacagcacaagtgccctatgcgcgttatcaacttgagaagatagaggaaaccagaaagaaaatgaaagaacaagatcttcaggaactttatggtgtttcagaactaaacctatcatcaccttttactgattccaggaatataagtgctgatgaaatgtcaaagacctcatgtaactatggtttggacgtcaatgatgtaccacctgttaataatgaatctgaggtacaaagtggggcaggccagtgttcagattacattgacaaggatagaagttatgctgggatgcataacggggagagaaccggtggtgccttatgggatattttccgaagagaagattctgacaagatacaagattatcttaggaaacatgccacggaattccggcacatcttttgcaatcctgtgaagcaggttattcacccaattcacgatcagactttctacttaaccgaggagcataagagaaagctcaaggaagaatatggtgttgaaccctggacgtttgagcagaagcttggtgaagcggttttcattcctgctggatgtcctcaccaagtgaggaacttgaagtcttgcattaaggttgcgatggactttgtctccccagaaagcgtcaacgagtgcatgaaactgactggagagtttaggcggcttccacctgatcacagggctaaagaggataagctggagatcaagaagattgctcttcatgctctgaaccaagtagtaaatttcttggatccttcctcggagtggtcgaagagttggtttgcccaactcaagaacaaaaaaaaggctggagctgaagaacaggagaagcctaaaaggaagcgtggccgcccatgtcgcaagtccaacgatgaagctgctggcgataggcacagaaagaagggcggccgccaaagaggtcggaagaggggatacggcaagtccaaagatggcgctggcgctgttgatgtgaagcctcctaaaaggcagcgcaatctcctgaaaggctctggcaatcgtgtaggtggttga

SEQ ID NO: 237 - DNA, 1836 bp, Zea mays
atggcgaccatggagagcctgatcgggctggtgaaccgtatccagcgcgcgtgcaccgtcctcggcgaccacggcggcggcggcggcgagggctccctctgggaggcactcccctccgtcgctgtcgttggtgggcagagttccgggaagtcgtcggtgctcgagagcatagtggggagggacttcctgccccgtggatctggcattgtcacgaggcggcctttagtgctgcagctccacaagacagatggtgggcacgagtatgctgagttcctccacgccccgcggaagcgtttcaccgactttgctgctgtgaggaaagagattgctgatgaaacagatcgcataactgggaaaactaaagctatttcaaacgttcccatccatttgagtatatattcaccacatgttgttaacttgacacttatcgatcttcctggactgacaaaggtcgctgtagaggggcaaccggaatctattgttcaagatattgaaaacatggttcgagcttatgttgacaagccaaattgcatcatcttggctatctccccagctaaccaagatattgcaacgtcagatgctatcaagcttgctagggatgttgatccttcaggtgacaggacttttggagtcttaacaaagcttgatttaatggacaagggtaccaatgctgttgatgtgcttgaagggaggcaatatcgcttacaacacccgtgggttggaattgtcaatcgctcacaagctgatatcaacaagaatgtcgatatgctctcagcaagacgcaaagaaaaagagtactttgagagtagtcctgaatatggtcacttggcacataaaatgggtgcagagtatcttgccaagcttctgtcacagcatttagaggctgtgatcagggcaaaaattccaagtattatagctatgattaacaaaacaattgatgaaatagaagcccagttggatcgacttggtaggccaattggaggtgacgctggggctcagttgtacacaatcttggatatgtgtcgggcatttgaccgtgtctttaaagagcacttagatggcgggcggccaggtggagatcggatttatggtgtctttgacaaccagttacctgcagcactgaaaaagcttccatttgaccggcatctttcaatgcaaaatgttcgcaaagttatttcagaggctgatggttaccagccccacttgattgcccctgagcaaggatacagaaggcttatagatagttctctaagctactttaagggtccagctgaagcatctgttgatgcggtccatttggtattgaaggagcttgttcggagatctattgcagcaacagaggaattgaagcgattcccaacacttcaatcagatatagctgctgctgcaaatgatagcttggaaagattccgtgaggatggacgaaagactgttcttcgtctagttgagatggaagccagctacctaacagtagagtttttccgtaaacttcctactgaaccagagaaagcagctgataagaacactccagtgagtgataggtatcaggacaatcatctcagaagaatcggatcgaatgtgtcatcttatattaacatggtctgtgagactctaaggaacacggttccgaaagccatcgtgcattgccaagtgaaagaagcaaaaagaaatttgcttaaccgtttctatgctcatgtgggaagcaaggagaagaaacagctgagcgcgatgttggatgaggaccccgctttgatggagaagagggatgccttggtcaagaggctagagctgtacaaatctgcaaggaatgagatcgactcggtcgcatggaaatga

SEQ ID NO: 238 - DNA, 1359 bp, Zea mays
atgagggaggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtgctgtttttgttgaccttgaacccactgtcatcgatgaggtgagaactggcacctaccgccagctcttccaccctgagcagctcatcagtgggaaggaggatgcagccaacaactttgcccgtggtcactacaccattggcaaggagattgttgacctgtgccttgatcgcatcaggaagcttgccgacaactgcactggtctccagggcttcctcgtcttcaacgctgttggtggaggaacgggctctggccttggttccctcctcctagagcgcctgtctgttgactacggcaagaaatccaagcttgggttcactgtgtacccttccccccaagtttctacttcggtagttgagccatacaacagtgtactgtccacccactccctcctcgagcacactgatgtggctatactgctggacaatgaggccatctacgacatctgccgccgatcccttgacattgagcgcccaacctacaccaacctcaacaggcttgtgtcccaggtcatctcatcccttactgcctccctgaggttcgatggtgctctgaacgtggatgttaacgagttccagaccaacctggtaccctacccgaggatccacttcatgctttcttcgtacgctccagtcatctctgctgagaaggcctaccacgagcagctctctgtggctgagatcaccaacagtgccttcgagccatcttccatgatggccaagtgcgacccacgccatggcaagtacatggcctgctgcctcatgtaccgtggtgatgtggtccccaaggatgtgaatgctgctgtggccaccatcaagaccaaacgcaccatccagttcgtggattggtgcccgactggcttcaagtgcggcatcaactaccagcctcctagcgttgtgcctggtggcgacctggccaaggtgcagcgtgccgtgtgcatgatctccaactccaccagtgttgtggaggtgttctcccgcatcgaccacaagttcgacctcatgtacgccaagcgtgccttcgtgcactggtacgtcggtgagggtatggaggaaggtgagttctctgaggcccgtgaggacctggcggcgctcgagaaggactacgaggaggtcggtgctgagttcgatgagggcgaggatggcgacgagggtgacgagtactag

SEQ ID NO: 239 - DNA, 3231 bp, Zea mays
atggacggcggcgacgccacgaattcggggaagcatgtggccgggcaggtgtgccagatctgcggcgacggcgtgggcaccgcggcggacggcgacctcttcaccgcctgcgacgtctgcggcttccccgtgtgccgcccatgctacgagtacgagcgcaaggacggcacccaggcgtgcccgcagtgcaagactaagtacaagcgccacaaagggagcccaccagtacacggtgaggaaaatgaggatgtggatgctgacgatgtgagtgactacaactaccaagcatctggcaaccaggatcagaagcaaaagattgctgagagaatgctcacctggcggacaaactcacgtggcagtgatattggcctggctaagtatgacagcggtgaaattgggcatgggaagtatgacagtggtgagatccctcgtggatatatcccgtcactaactcatagccagatctcaggagagattcctggagcttcccctgatcatatgatgtctcctgttgggaacattggcaggcgtggacatcaatttccttatgtaaatcattctccaaacccatcgagggagttctccggtagccttggcaatgttgcatggaaagagagggtggatggatggaaaatgaaggataaaggtgcaattcctatgaccaatggaacaagcattgctccatcagaagggcgtggagttgctgatattgatgcttctactgattataacatggaagatgccttactgaatgatgaaactcggcaacctctatctagaaaagtgccaattccttcatccagaataaatccgtacagaatggtcattgtgctacgtttggctgttctatgcatattcttgcgctaccgtatcacacatcctgtgaacaatgcatatccactgtggcttttatccgtcatatgtgagatctggtttgctttgtcctggattttggatcagttcccaaagtggtccccaatcaaccgtgaaacataccttgatagactggctttaaggtatgaccgagaaggtgaaccatctcaattagctcctgttgatatctttgtcagtactgtggatcctatgaaggagcctcctcttgtcactgcaaatactgtgctttccatccttgctgtcgattatccggttgacaaggtatcttgctatgtttcggatgatggagctgctatgctgacttttgatgctctctctgaaacttcagagtttgctagaaaatgggttccgttctgtaagaagtacaacatagagcctagggctccggaatggtactttgctcagaaaattgattacttgaaagacaaagttcaaacttcatttgtgaaagaacgccgggccatgaagagagaatatgaagaattcaaagttcgtatcaatggtcttgtagccaatgcacaaaaagttcccgaggagggatggatcatgcaagatggtacaccttggcctgggaacaatactagggaccatcctggaatgattcaggttttcctgggtcacagtggagggcttgacgttgaaggcaatgaacttcctcgtttggtttatgtgtctcgtgaaaaacgtcctggattccaacatcacaagaaggctggtgccatgaatgcacttgttcgtgtatcagctgtccttactaatgggcaatacatgttgaatcttgactgtgaccactacatcaataatagcaaggctcttcgagaagctatgtgcttccttatggacccaaacctaggaaggaatgtctgttatgtccaatttcctcagaggtttgatggtattgataggaatgaccgatatgcaaacaggaacactgtgtttttcgatattaacttgagaggtcttgacggcattcaagggccagtttatgtgggaactggttgtgtgtttaacagaacggccttatatggttatgagcctccagtcaagaaaaaaaagccaggcttcttctcttcgctttgtgggggaaggaaaaagacgtcaaaatctaagaagagctcggaaaagaagaagtcacatagacacgcagacagttctgtaccagtatttaatctcgaagatatagaggaagggattgaaggttctcagtttgatgatgagaaatcgctgattatgtctcaaatgagcttggagaagagatttggccagtccagtgtttttgtagcctctactctgatggaatatggcggtgttccacaatctgcaactccagagtctcttctgaaagaagctattcatgtcatcagctgtggctatgaggacaaaactgactggggaactgagattgggtggatctatggttctgttacagaagacattctcaccggattcaagatgcatgctcgaggctggcgatcaatctactgcatgcctaagcgaccagctttcaagggatctgctcctatcaacctttcggatcgtttgaatcaagtgcttcggtgggctcttggttccattgaaattcttttcagcaggcattgtcccatatggtatggctatggaggtcggcttaaattcctggagagatttgcttatatcaacacaacaatttatccactcacatcaatcccgctcctcctgtactgcatattgccagcagtttgtcttctcactgggaagttcatcatcccaaagattagtaacctagagagtgtttggtttatatcgctctttatctcaatctttgccactggtatccttgagatgaggtggagtggtgttggcattgatgaatggtggaggaacgagcagttctgggtcattggtggtatttctgcgcatttatttgccgtcttccagggtctcctgaaggtgcttgctggtatcgacacgagcttcactgtcacctctaaggccactgacgaagaaggtgattttgccgagctctacatgttcaagtggacaacgcttctgatcccaccaaccactattttgatcatcaacctggtcggcgtggtcgctggcatttcctacgcaatcaatagcggttaccagtcatggggacctcttttcgggaagctcttctttgcgttctgggtgattgtccacctgtaccccttcctcaagggcctcatggggaagcagaaccgcacgccgaccattgtcgttgtctgggctatcctccttgcgtcgatcttttccctgatgtgggttcgtatcgatccattcaccacccgggtcactggtcctgatatcgcgaaatgtggcatcaactgctag

SEQ ID NO: 240 - DNA, 492 bp, Zea mays
atggactcatccgtcgagaagcaggggagcgtggcgctggatccggacgagcgcgcgccggcgtccggcgaaaccaaggcctgcaccgagtgccacaccaccaagaccccgctctggcgcggggggccctgcggacccatgtcgctgtgcaacgcgtgcgggatccggtaccggaagaagagacgggaggccatgggcctcgagtccagcagcaaggccgccaccgccggcggcagcgagcaccagcagcagcagcggaagaagaaggccaccgcggcggcggccgccgcctcctccaagcgggagcgggagcgtgagcgggagcggaacaaggaggcggacgaggtcaccgtggagctccgcgcggtggggttcggcaaggaggtggtgctgaagcagcggcggcggatgcggcggaggcgccgcctgggcgaggaggagcgcgcggccatcctgctcatggcgctctcctccggcgtcgtgtacgcctga

SEQ ID NO: 241 - DNA, 1143 bp, Zea mays
atggacagcatggaggacgccgtctccggcactgcagcccagggcgacctcgccgaggttgtggcccgcgcaggtgcaatggccgccgcggcgagtcaccaccaccaccggcggccaccctctcccgcagcagcagatcacggccacatcgtgtctgctgcaagggccaccgccagatcacagatcatgctcgtccctgctgctgcttgctacgacgacgagacacggcctgctgctgcttgcggcgacgcggtgatgttcgacgcgccgtcgtcgtcgatggccgccgccgtcggtccataccaccacctgtcgtcttcgtctgcggcgctggcaccggcgcacggcgggtactggctgccgccgcaacagatctcccaggagcacgcccgcgacggcggcctcgacgagccgcccgtggtgacgaggatctcgccagtgacgactccaccgccgccttctcatcatcatcaaatcatgaacagaaagaatgaggtgaagaaggtggtgtgcatcccggcgctaccacctccggcgagcagccgcccaggaggaggagaggtgattccgtctgatctttgggcgtggaggaaatacggccagaagcctatcaagggttcgccttacccaagaggttactacagatgcagcagctcaaagggatgtatggcaaggaagcaagtagagcgcagtcgcagcgaccccaacatgctcgtgatcacctacacggcagaacacaaccacccttggccaatgcaacgcaatgtgctcgctggctactcccggcctcacactgctactcacatgtcgtccaactgcaagaagaagaagaacagctgcagcgttgaaccgacgagttcatggccaacaacaacaacatcatcaccatcatcaaagaacggcaactacgagtgtcagcaaatgacaaacatgacgatggaagaaaatgcagcagcagggtatgttgcctacgccatcgatgacgaggagtgtgccgcgatgcatcagccgatcaattgcggtagcgtgcaaccttcagcagatgaggttttcgcagagctagaggaattggagcctacgactagtcctgtgaatgcaaacatcttctctaggggggtgacttatgagtggcacaagttctaa

SEQ ID NO: 242 - DNA, 2160 bp, Zea mays
atggcgccccccgcgctggactctctcccggcgccgctccggtcgctgcggctcaagacgaagcagcaggagctcctgctccgcgtctcggcgctggcgctcatctacgtgctcgccttcgccgtccgcctcttctccgtcctccgctacgagtccatgatccacgagttcgacccttacttcaactaccgcaccacgctcttcctcaccgagaacggcttcagcgagttctggaactggttcgacttcgagagctggtacccgctcgggcgcgttgtcggggggacgctctacccgggtctgatggtgaccgccgcgctgctccaccgcctcctccgcgcgctctacctcaccgtccacatccgtgaggtctgcgtcctcaccgcgcccttcttcgctgccaacaccacgctcgtcgcctacgccttcggccgcgagatatgggactccggggcggggctcgtcgccgctgcgctgatcgccatcgtccctggctacatctcccgctccgtcgcggggtcctacgacaacgagggcgtcgccatcttcgcgctgctgctcaccttctacctcttcgtgcgcgccgttaacactgggtcgctcgcctgggcgctcgcctcggcgttcggttacttctatatggtgtcggcatggggaggctacgtgttcatcatcaatctcgtcccgctttatgtgcttgtgttgcttgtcactgggaggtactcgcagaggctctacgtggcctacaattgcatgtatgtgcttgggatgttgcttgcaatgcagattcgttttgttggattccagcatgtgcagtccggagagcacatggctgctatgggagtcttcttcctgttgcaggttttcttcttcttggactgggtgaaatatctgctaaatgatgccagactattcaagtcattccttcgaattaccctcacatgtgtgattactattggcaccctggctcttggacttggtactgcatctggttacatctccccttggacaggacggttttactccctgcttgatcctacctacgcaaaggaccatataccaatcatcgcatctgtttctgagcatcagccaacagcatggtcctctttcatgtttgacttccacatcctacttttcttgttcccagctggcctttatttctgtttcaagcgcctgtcagatgccacgatatttattgttatgtatggcctcacaactatgtactttgctggtgtgatggtccggttaattcttgtggcagcaccagccgtttgccttattagtgcgattgctgcatctgctacaataaaaaatctaaccactttgatccggacaaagagcaaaagtccacagactactggaaaaacaactggttcaaaggcaggtgcaaagggagcagttgatcaatctttaccattccaacacaatgcagctattgctcttcttctcggtgccttttacttgctcagtaggtatgcaatacactgcacttgggtgacatctgaggcctactcttctccatctatagttttggctgcaaggggtcataatggtggaagagtcatctttgatgattatcgtgaggcatactattggcttcgtcagaacacgcctcctgatgctaagattatgtcttggtgggactatggataccaaattacagctatgggtaacagaactgttattgttgataacaatacatggaataacacacacatagctacagttggacgagctatgtcatcttatgaagatgaagcatatgagatcatgcagtcacttgatgtgaactatgtgcttgttgtgtttggaggtgttactggatattcttcagatgatatcaacaagttcttatggatggtacgtattggtggaggagtttttcctgtaatcaaagagccagattaccttgttaatggggagtatcgtattgacaagggggcagcacccaaaatgctgaactgcctaatgtacaagctttgttactaccgatttggagaacttaccacagaatatggaaaacctccagggtatgatcgtgtacgaggagtggagattggcaacaaagacataaagcttgaatacttggaggaggcatttacaacttcaaactggatagtgcgcatatacaaggtgaaacccccaaagaacaggtcctga

SEQ ID NO: 243 - DNA, 2121 bp, Zea mays
atgtctgaaccagcacaacctagtggaggggaaggtgatgtcaacacgctccgaatacttgtagcaaccgactgccatctaggctacatggagaaagatgagatacgtaggtttgattcctttcaagcatttgaggagatttgcgcattggcagataaaaataaggtggattttatacttctcggtggtgatctattccatgagaacaagccgtcacgctcaaccctggtaaaaacgattgagattctacggcgctactgcctaaatgatcaacctgtgaagttccaggttgtcagtgatcagacagttaactttccaaacaggtttggtaaggtaaattatgaagacccaaactttaacgttggtctgcctgtgttcaccattcatggaaatcatgatgaccctgctggagtggataatctctctgctatcgatattctttcggcttgcaatcttgtaaattattttggaaagatggaccttggtggctctggcgttggtcagatagcagtttatcctgtacttgtaaaaaagggcatgacttcagttgcactgtatggtcttggaaacattagagatgaacgactaaatagaatgtttcagacgcctcattcagtacagtggatgcgacctggaactcaagatggggagtcagcgtctgactggttcaatatattggtacttcatcagaataggataaagacaaaccctaaaagtgccatcaatgagcatttcttaccacgtttcctggattttattgtatggggccatgagcatgaatgtcttattgatcctcaggaggtccctggaatgggtttccacatcacacaaccaggttcatcagtcgcgacgtccctgattgatggtgaagcaaaaccaaagcatgttcttttgttagaaatcaagggaaatcagtacaggccaaccaaaatacctctgagatctgtcagaccttttgaatatgctgaggttgtgttgaaagatgaagcagatgttaactcaaatgatcaggactctgtgcttgaacatttggataaaattgtaagaaatctgattgagaagagtagccaaccaactgccagcagatcagagcccaaacttccattagttagaatcaaggtagattactctgggttttcaacaataaacccacaacgttttggtcagaagtatgttggaaaggtcgcaaaccctcaagatattctcattttctcaaaatcagcaaagaagcgccagactacaggagatcacattgatgattctgagaaacttcgtcctgaggaactaaaccaacaaacaatcgaagctctggtcgcagagagtaacttgaaaatggagattcttccggttgatgatttggacattgcgttgcatgattttgtgaacaaggatgacaagatggcattttattcatgtttgcagagaaaccttgaagaaaccaggaataagttgagttctgaagcagataaatccaaatttgaggaagaagatataatagtcaaagttggcgagtgcatgcaggaacgcgttaaggaaaggtctctgcactctaaggacggcacacgtttgacaacaggctctcacaacttggatactggaggtaaatcttttacagctcaaagcaaccagaactccttcagtgatgatgaagacaccagggagatgcttcttggtgcaagatcaactgatgttggacgaaaatcatctggatttactagaccctccaaagatactgctgatgttgctaaacgtggtacttccaaaagaggcaggggaagaggcaccagttcaatgaagcagaccactcttagtttcagccagtcaaggtcagctaccgttattcgtagtgaggatgtggcttcctctgaggaggaagcagatgcaaatgaagttgttgaaaattcagaagaggagagtgcgcaacaagttggacgtaaaagagcagctcctaggggtagaggtagaggtagaggcggaggttccactgcaaagagggggcgaaaaacagatattgcttccatgcaaaatatgatgagcaaagatgatgatgattcagaagatgaaccgccaaagaaaactcctcgggtcaccaggaactatggcgctgtcaggaggagatga

SEQ ID NO: 244 - DNA, 3537 bp, Zea mays
atggagcccgggttgagcatcgagtccggttctgccatccgcgtcgcggtgctccccgtgggcggcccgattccgccgccgcgcctgcgcgagtacgcggccctggtggcgcgccacgcgcgcgtcgacctcgcctcgctccgcacctactacgcggagcaccagaagagccccttccagcaccagccctgggagaccggatgcctccgcctcaagttcgtgctcggcggctgcgtgccttcaccctgggaggacttccagtcctcgcgcaaggtgctcgccgtgatcggcatctgtcacctgccgtcctcgcccgacctcgaccacgtggcggcagacttcatagacgctgcgcggtcgtacccgtcggcgctcgccaaccgctgcttcgccttctgccccacggacgcacagctgtcagcgaagaagagggacgatattattatgttccctccttctgatcagcaatcgctggaacttcatatgcttacaatgatccaagatctcgctgcttctttgttgatggagtttgagaagtgggtcttgcgtgcagaatccacaggaaccattttgaagacccctttggattcacaatccagtcttggctcagaggaggtaattaaggctaaaaaaagaaggcttggtcgtgcacagaagataataggagattattgcctcttggctggatcacctgtggatgctaatgcacattacaccaccgctatagagcttgcaagattgaccggtgatgttttctggcatgctggagcccttgagggtagtgtctgcgcattagtggtggataggatgggccaaagtgaccctattttggaggatgaagtcaaatatcgctattacaccattatccagctatacagaagagccactttacaagataatgctcaaagagtttcacctgtgagctttgagcttgaagctgccttgaagttggcaagatacttgtgcaggcgagaacttgccaaggaggtctcagatttgttaatgggagctgctgatggtgccaaggctcttattgatgccagtgatcggctcatactatatattgaaattgcaagactttttggtacacttggttataagcgcaaggcggcctttttttcaagacaagttgcacagttgtaccttcagcaagacaatgcatatgctgctatgagtgctatgcaggttctaactatgactacaaatgcataccatgtccaaagccgaaagactatgaaaatgaatcatgatccgtccaaggaacctcgtgctggcaatactgattctggaaaggtgcaccctcagtctatagtgtcattgtttgagtcacaatggagtacccttcaaatggtggttctaagagaaatattgatatcgtcgatccgggcggcagatccactctcatcatggagcgctgcagctcgtcttcttcgatcattttacccactcatcacaccagctggtcagagtggcctagcaagctcacttgcaaacgctgctgacaagcttccaacaggcacacgctgtgccgatccatgtcttccttttatcaggttgcattctttcccgcttcacccttctcaaagggatatagtaaaacggaatccacataaaaaggagtggtgggctggtgcaggtccttcaggacctttcatttatactcctttcagcaaagcaggagcttctgggacttccaagcaagagcttagttggattgtgggggagccggttcaagtcatggttgagttagcaaacccttgcagcttcgacatagttgtggagagcatctatctctctgtccattctgggaattttgatgcctttccagttagcgttagtcttccacctaacacttcaaaattagttttattatctggtattccaacaaaagtcggacaaatatcaattcctgggtgcattgttcattgctttggtgttattacagaacacctattcaaagaggtcgattgtttgctccttggagctgcacaagggcttgtcctttctgatcctttcagatgctgtggctctagcaagttcaagagtgtcaactttcctagcatttctgttgttcctcctctgccattgttaattgccaatgttgtgggtggagatggttctattcttctttatgaaggagaaattcgtgatgttctgataacactgacaaatgccggaaccgtgccagttgaagaagcaaatgttgcattgtcagggaagaatcaggattctgttatttcgattgctcatagcacatggaaatctgcgctccctattaaaccgggtggagaagtgacatttgcagtgactctaagagcctggcatctcagctcagcagatttggaagcagatggcagtagatctcctgtaaattcaaggagaatagcaagagaaggaaccaatccattcttggatattcactatgctggtcctgctgcgaatcttgagaatggagatgtttctcttctacctggaagacgcctagttgttcccttgaatatctgtgttgtgcagggcatgcgtcttgtaagagcacgcctgttgtccatggaaatacctgctcgatttactgaaacacacttaaaacctgtcagtggcaaagacataaacttattgaaggttgatccctataaaggaagctgggggctccgccttctggaacttgagcttttcaatcctactgatgtcgttttttatgttgatgttgctgtgcatttggatgacacggatgtggaccaagaagtaatttcagacggggatgctgcttgtcacaaaactagaattgatcgggactactctgccagagttctcatacctcttgagaacttcaaattgcctgttcttgatgcttccttctttgtaaaggcaagtagtagtgatgaacctcttggatccagggccgccgccatagcagaaaggaatgccaaggcagagctaaatgcgtctatcaacaacttgatttcaaaaataaaagtgaaatggcactctgggagaaatagctcaggtgagctgaatattaaagatgctatccagacggcactacaagcatctataatggacatactgttgccagatcccctgatgtttagctttaagcttgttacgaatggaactgtggtcaatgtcgattctccaaaggattctggcaatgttctgaggtgcaaagatcctatatctgctcatgaaatgacccatatggaagttcagattcgcaacaacacaaaggaaattatccggatgaaccttagcatttcatgcaaagatgttgctggagagaattgcttcgatgaaaatagtgctactgtcctctgggctggtgttcttagcgatatacacctggaagttccaccgttgcaagaggtggtacatcctttctccatgtatttccttgtaccgggtgactactcgctccaagctgcttctgttataatcgatgccacagacgttcttcgtgctcgtgcaaaggcggagtcaccagatgaacctatactgtgtcgcggatccccattccatatccgggtagtcggtacagcatag

SEQ ID NO: 245 - DNA, 465 bp, Zea mays
atggcgtccaaggttgagctggtggtggaggtcaagtccccggctgacaagctgtgggcggcgctgcgtgactcgacggagctgttccccaagatcttccccgagcagtacaagagcatcgagaccgtcgagggcgacggcaagtcggccggcaccgtccgcctcctcaagtacaccgaggcggtgccgatgctgacgttcgccaaggagaagcttgagacggcggacgacgagaacaaggtggtgtcgtacagcgtggtggacggcgagctggcggacttctacaagaacttcaagatcacgctgaaggtgactccggccaaggcggagggcgagggcggcgccgtcgtcagctgggccatggagttcgacaaggccaacgaccaggtgcctgacccggacgtcatcaaggagaccgccaccaagacgttccacgacctcgacgactacctcctcaagaactag

SEQ ID NO: 246 - DNA, 1365 bp, Zea mays
atgatatttttattaacggatagaaaaatgctattatcaagtagtaaaccctttatgattgcaacttgtgggatgcctggaatcccactaaatcgagaatcggaatcggtggaggatgtgcatagggtactccgagccctccccttatttagagaaatggaaggtatcttgcgtgagaggaacctgaatctcccgtcagtacaggaaataagcgctttccgtgtgaatctattctctggtatccggcgtgagagtgcgattgcggactacgacgctttttggcgctccttactcgaggagattcacacacctcagggacgtagttgttttggtcagagaatacaagatctgcacgcccgaatgtctgccgagggcaactgggactacttgattgcccaacaaggcagagggtattttggtaacctacctaatctcaacagcccgttggatcaatatcaatttggaattcacccaattctggatctgaatattggtgagtactatgtctcattcacaaatctatccttgtctatgctactcactctcggtttggtcctacttctggtgctgccaatgattcttcgttcattagaatgtcgattcctcacaatcgctctttgtgatgctgcggaaccatggcaattaggatctcaagacgcagcaacacctatgatgcaaggaatcattgacttacatcacgatatctttttcttcctcattctgattttggttttcgtatcacggatgttggttcgcgctttatggcatttcaacgagcaaactaatccaatcccgcaaaggattgttcatggaactactatcgaaattattcggaccatttttcctagtgtcattccattgttcattgctataccatcgtttgctctgttatactcaatggacggggtattagtagatccagccattactatcaaagctattggacatcaatggcgggcgtcgacccaaccttatgagtattcggactataacagttccgatgaacagtccctcacttttgacagttatacgattccagaagatgatccagaattgggtcaatcatgtttattagaagttgacaatagagtggttgtaccagccaaaactcatctacgtatgattgtaacacccgctaatgtacctcatagttgggttgtaccttcctcaggtgtcaaatgtgatgctgtacctggtcgttcaaatcttacctccatctcagtacaacgagaaggagtttactatggtcagtgcagtgagatttgtggaactaatcatgcctttacgcctatcgtcgtagaagcagtgactttgaaagattatgcggattgggtatccaatcaattaatcctccaaaccaactaa

SEQ ID NO: 247 - DNA, 222 bp, Zea mays
atgatcgaggtggtgctgaacgaccgcctggggaagaaggtgcgggtgaagtgcaacgaggacgacaccatcggcgacctcaagaagctggtggcggcgcagacggggacgcgccccgagaagatccgcatccagaagtggtacaacatctacaaggaccacatcacgctcaaggactacgagatccacgacgggatggggctcgagctctactacaactag

SEQ ID NO: 248 - DNA, 1719 bp, Zea mays
atggcttcgacctccgttcctgagttaaccgcggacaagaaatgcgacaaagccatcgcggatacggcggcaccacttacttctcagggacactccgaagaaccgactgggaaagtcagcacactagtgcctgctttgccggttgtaattgcagcaggcgatggggctgcatccagtggggtgatagaaaacagaaatggcatggacaattctgctgatggttctttgaagcgggatgacagtgaaggtgctgagaagagctcgctgcgggggagcgtcaaggatagctcggtgtcggctaaatgcagtgacagggcgagcagcctgtcgaaagccagtgggagcgccaagatcagcggtcaacctgctgacatgatcgagagtggcaagagtagtctctatcgggccagtggtggaagtgatctgagtgatgagagcacctgcagtagcatatgcagcagtgtcagcaagcctcacaagtcaaacgactcaaagtgggaagcgattcaggttgtccgaaccaaagaaggttctgtaggtctaggtcatttcaggctgctcaagaggctcggttgtggtgatattggcagtgtgtacttatcagaacttagtggcactaaatgctattttgccatgaagatcatggacaaggcgtcattagcaacccgcaaaaagctgcttagagcgcagactgaaagggagatattgcaatgcctggatcatccttttcttccaacattgtacactcactttgagacggataagttctcatgcttggtgatggagttctgccctggaggtgacctacataccctaaggcaaaagcagcctggcaagtatttccctgaacaagctgccaagttttatgtagcagaggtgcttcttgctctggaatacctgcacatgcttggtatcatataccgtgacttaaagccagagaatgttcttgtgagggaagatggacatatcatgctgtcggatttcgatttatccctccgatgtgctgtgagccctactcttctcagatcttctaaccccagtggggataaccaaaagggcaacccagcttactgtgtgcagcctgtgtgcattgagcctgcctgtatgcagccttcttgtgtcacgacaaccacatgcttctctcctcgctttttctcttccaaatccaaggagaaaaaagataaaaaggcaaaggcagacttggcaaatcaggtcagaccacttcctgagcttgttgcagagccgacagatgcaaggtctatgtcttttgttggcacccatgagtacttggcacctgaaattataaagggcgaggggcatggaagtgctgtagactggtggacatttggcatattcttgtatgagcttctcttcggcaagacaccattcaaaggttctgggaatagggcgacattgttcaacgtagttggacaacccttaaggttcccagaatcacctgtagtgagttttgctgcaagggatcttattaggggattgctcatcaaggaacctcagcatcgattagcgtataagcgtggagccacagaaataaaacagcacccgttctttgaaggtgttaattgggcattaatcaggtgtgccactccacctgatatccccaagccagttgagatccctcgttctgtagcttcatcaagccagaaggctacatcagccgctgagaaaggctcagattatcttgaattggagtttttttag

SEQ ID NO: 249 - DNA, 783 bp, Zea mays
atggcactcgtctccgcctcctcgtcctccaccaccgccgtcacggcgctccccaggaatgggcagcgggcgtcgtcctccttcctcggcggcaagacgctgctgagacaggccgaggcggcccggccgtcgttcgccgtgcgcgccgcggcggaccccaacaggccgatctggttccccggcagcacccctccgccgtggctcgacggcagccttcccggcgacttcggctttgatccctggggcctcggatctgacccggagagcctgcggtggaacgtgcaggcggagctggtgcactgccggtgggcgatgctcggcgcggcgggcatcttcatcccggagtttctgaccaagatcggcgtcctcaacacacccttctggtacaccgccggcgagcagcagtacttcaccgacaccaccaccctcttcatcatcgagctcatcctcatcggctgggccgagggccgccgctgggctgacatcatcaagcccggaagcgtcaacaccgaccccatcttccccagcaacaagctcaccggcaccgacgtcgggtaccctggtggcctctggtttgacccgctcggctggggcagcggctcgccggagaagatcaaggagctgcgcaccaaggagatcaagaacggacgcctcgccatgctcgccgtcatgggcgcctggttccaggccgagtacaccggcaccggccccatcgacaacctcttcgcccacctcgccgaccctggccacgccaccatcttccaggccttcacccccaaatga

SEQ ID NO: 250 - DNA, 1032 bp, Zea mays
atgatgatcccgtggggcggcgtggggtgttgcctcagcgctgcggcgctgtatctcctcgggaggagcagcggaagggatgcggaggtgctgcggtcggtggcgagggctggcagcatgaaggatttagctgctatcttggacactgcaagtaaagtcctaccacttgtagttgccgtctctgggagagttggttcagacacaccacttatatgccaacaaagcggcatgagaggtgtgatcgttgaggaaacggcagaacaacacttcttgaagcacaacgatgctggatcctggattcaagattctgcagttatgctttctgttagcaaagaggttccatggtatctggatgatggaactggacgtgtatatatggttggtgctcgttctgcagctggtttaattttaactgttgccagtgaggtttttgaggagtcagggaggacacttgtacgtggaactctagattatttacaagggttgaagatgctgggagtaaaacgaactgaaagggttcttccaactggaatctcattgacagttgttggtgaggctattaaagatgatgttggaactattagaattcagcgaccgcataaaggacccttctatgtatcaccaaaaagcatcgatcaacttattatgaatcttggaaaatgggccaagttataccgccttgcttcaatgggctttgcaacatttggtgccttccttcttgcaaagcgtgcaatacaacattttctagaaagaaagcgccggcatgaactgcaaaaaagggttcttaatgcagcagcacaaaggcaagctagagaagctgaagggagcattggttcatcggacacagagcctaacagtaaaaaagaccaattagtgttggacatatgtgtcatatgccttgagcaagagtacaatgctgtttttgtgccgtgcggtcacatgtgttgctgtatggcatgctcttcacatttgacaaactgcccgctttgccggagaagaattgaccaagctgtcagaacattccgccattga

SEQ ID NO: 251 - DNA, 1518 bp, Zea mays
atgtaccgagtcgcctccgggctcggcgccctcaagaggcatggggcaaatgctcaaatgatgaatgctgcaattaggtgtgccagcacaagtgttgcacagaggtcttcgggtggcttctggacctggttgactggtgcgcgttcaaatgaaatacctcctccagatttcacacttccaggagtgactattcctcctccgctgcctgaccatgtggaggctggcaaaacaagagtcacaacacttcccaatggtgttaaaatagcctctgagacatctgcgggatcatcttgttctgttggagtttatgttgattgtggttctgtatatgaagcacctgaaacaacaggcgccagtcaactgttgaagacaatggccttcacaaccactgccaacaggagtgagttgcgggttgtgcgtgaaattgaggcaataggtggcagtgccaaagcatctgctagccgtgagatgatgagctacacttacggagccctgaagacttacatgcctgaaatggttgaggtgcttattgattgtgtacgcaaccctgcttttcttgattgggaggtcaaggaacagattttgaggctacaggcagagcttgcaaaatcatcaagttttcctgaaaattttcttttggaggctcttcattctactggctattctggtgctttagcaaatccactaattgtgccagaatattcagttagcagattgaatgcagatgtcctggaacaatttataactgagaactacactgcttcccgaattgttctagctgcatcaggcgttgatcatgatgaattggtatctattgccgaaccccttctgtctgacattcccagtgtatctggaacaacaaggccaaaatcaacctacattggtggagaatacagaagaagtgcagattcatcgagcacagacgttgcattggcattcgaggtcccaagtggttggctcaaagaaaaagattgcgtcactgtatcagttcttcaggcacttctgggtggtggtggcaagttttcttggggaaggcaaggaaaggggttacattcacgtctaaaccgcctcgtaaatgaatttgatcagatcaagtcaatctctgctttcaaggatgttcacagtaatactggcatctttggaatccatacatctactgatgcatcatttgttcctaaagctattgacctagcagccagagagctcacttcccttgcaactcctggacaagttgaccaaagccaactggaccgcgctaaagcctcagctaaatatgcgatactggcaaatttggaatcacaggcatcgctaacagaggacatggggcgccaagttttggcatttggtgaaaggaaacctgctgagcaccttctcaaggctgtagatggtgttactatgaaagatataacgtctgttgctgaaaagatcatttcatccccattgacaatggcatctcatggaaacgttctgaatatgcctacttatgagtcggtcagtggcaagttccgctcaaaatga

SEQ ID NO: 252 - DNA, 2304 bp, Zea mays
atgatcgatcatcccgtcggctacagcgggggaagcacgcagtcaatacccgtggtcggcagcccgcagcccgcagccagcagcccccgcagaccgcagaccgcgcagcagtacctccagccagccctccactccccgtccgtcccgacgtgcgcgtgcgccgcacacgcgcaagcgcaactgctcaaaaccgcaccgcgccgagccgcagccgccgaggcccctggctttccctttttatacccctcgccacccgcatccccctgctccatccccccctctccacactgccaactcgctccgaagagggaggaggacgacgccggttgccactgccactgccgcgccgcgccgctcccgtctcccctccctccgcgggaactcgacgccaccatgctgtccacgcgcaccgccgccgtcgccgcctccgcgtcccccgcctccccgtggaagctgggaggacggagcgagggcggcgccagctgcgacggatgccggacctacaggaacaccctgcggaggagggccgcgcccgccaaggtgcgcgccttgccgcccaggcgggtggacgcggtcgcgatggtctccaacgcggagacggagacggagaaggagcaggaggaggcggcggccgccagcgaggagctgcccgtcatgccctgggccacctccgtcgcaagcggttacacccttttgagggatccacaccacaacaagggtcttgctttcacagaggaggaaagggatggacactacttgcgtggactgcttcctccggcagtactatctcaggaactccaaattaagaagttcatgaacaccctgcggcagtaccagacccctttgcagcggtatatagctatgatgaaccttcaggaaacggacgagaggcttttctacaagcttttaattgataatgtggtggagctgcttccttttgtttacacaccaactgtaggtgaggcctgccagaagtatgggtccatctttggacgaccacagggtctgtatgtcagcctgaaggacaaggggaaggtcctagaagttctaaggaactggccacataggaacattcaagttatctgtgttactgatggtgagcgaatcttgggacttggagatttgggttgtcagggaatgggaattcctgtaggcaaacttgctctatacactgctctaggaggagttgacccatcagtttgcttgcctatcacaattgatgttggtacaaataacgagaaactgcttaatgatgagttctacattggactccggcaaaaacgtgcgactggcgaggagtatgatgagcttattgaagagttcatgtctgctgttaagcaattctatggtgagaaagtcctcattcagtttgaggactttgccaatcacaatgcctttgatttgcttgaaaaatatagcaagagccatcttgttttcaatgatgatatccagggcacagcatcagtggtccttgcaggtttgttagcagcactcaagatggttggtgggaccctggcagagcagacgtatttgttccttggtgctggggaggctggaactggtattgcagaacttattgctcttgagatttcgaaacagacgaatgctccaattgaagagtgccgcaagaaggtttggctggtggactcaaagggtttgattgttgactctcgtaaaggctcccttcagccattcaagaaaccttgggcgcatgagcacgagcccttgaaaaccttgtatgatgctgttcagtccatcaaacctacagttctgatcgggacatctggagttggaagaacattcacaaaagaaatcattgaggccatgtcttccttcaacgagaggcctatcatcttttcactgtcaaacccaacctcgcattctgaatgcactgctgaacaagcatatacatggagtcagggccgttcaatctttgccagtggcagtccatttgcccccgtggagtacgaaggaaagacttttgtgcctgggcagtcgaacaatgcctacattttccctggactcggcctcggtcttgtgatctctggagccgtccgtgtccacgaggacatgcttctcgccgcctcgaaagcgctagctgatcaggccacacaggacaacttcgagaagggctccatcttcccacccttcaccagcatcagaaagatctctgcgcacatcgctgcagccgtggctgcaaaagcctacgagctcggtctggcgacccgtctgcctccccccagcgacctggtgaaatatgcagagaactgcatgtacactcccgtctaccgcaactaccggtag

SEQ ID NO: 253 - DNA, 408 bp, Zea mays
atggtcttcttttcttttaggtttcttgtgtcctttgatttggtactttgcaaccactctttactgctgcaagtactacaacaaagatcctcgagagcgccctgggctagctgcatcagctgttgcggcactcatcttcacagtcctggcactcatcgctctctctgtggcactgataatctatatataaaacgaggaatgaacttgcgcttgcttgaaatgcgtactcaggcactcatcttcacagtcctggcagccatacatcgctctctgtggcacagatcatctgaaacccaaagcgaggaaaacgcggtagctggacctggcattcagaaggaacttgtaatttcagtgatagtagcatatagttgcaatcatccttcatgtatcaccatatcaagttgttga

SEQ ID NO: 254 - DNA, 1920 bp, Zea mays
atggcgaccaccgaggactccgccgccgcgggcgaggcccgacgcctgttcgccctcctcgagtcccagcagcaggtactctctgactgccacggcgcctggtcgcgcgccctcgcacactttgcctcgcgcgaggaggacctcgcctcccgctccgctgcactcgacgaagccctagccgccgccgacgtttccacttccgagactctcgcagcgctcgaggcccgcgagtcctccattcccgcgcgcctcgctgaggcctccgccgcgctctccgccgccgtcgctgaggccgagactgaatccaccgggccaccacccaccgacatcaagggcgcgctccggtggatatgccgccgcatggacgctgctgcgctctggcgcttcatggccgcacgccgccgggagctcgcggtagtccggagggaggccggccccgccgtcgccatggccgtcgacccgccccgccttgtcctcgacgtggtaagcgatttcttagccgctggcgacggcgtcggcggggaccaatgctgggtgctcggcatgttgctgcgctctttgttcgatttggatggcaggaagcctcccgagataggagatacattggttgagagggcgtttgcagtaaccaaagagtggcaagagcgctttgggatcaatatggacaatttgtcttctgaagacaaggaggtggagatggccgaagctgatgggtcagagaactcaggagcaacagagaagaaagaaggaaaagaagatgaggagcaggaggaggtggaggaagaggacgaggaagaggaagaggaggaagacccagaggaggaggaggaagaggaggaggaggatgacccagaggaagtagaggaacctgaggcaccaggaaaggaagggaatgaggtgaagggagaaggggcagagggaaaggtgtctgaggagggagaaggggcaggggggaaggtgtctgaggagggagaaggggcagagggaagggtgtctgaggagggacaaggggcagagggtaaggtgtctcaggagggacaaggggcagagaaaataggacatgaggatgagaagaagggagcagcagtgggcaccatgaaagtgaagacgggagaagaaggtaataagggtgcatcagagcaatcggaggcacagatatttgtgcagatggtagcggcatttggattgaaggataagttcgatgaggagttcttgagaaggctgtttgttgctaatggacggaagagggagcttgctaggattgcatgcgtgcttggatttgaggaaagccttggagatattgttgaggaactaataaagtcagggaatgctatagaggctatatatgttgcccatgaggctgatttgcttgggaaatttccacctgtgcctctcttcaaatcttatctgcagaattccactgataaggctcaggcagtgttgaaaagtggaagacattccagttctgcacttgaagaggcaaacagcttggagggcaatgcatacaggtccgtcataaggtgcgtcgagtcctgccagctacaatcggtgtttcctttagaggtcctgaggaagaagttagggaagttggagaaagagaagtctgataggaagaaggcagctggtccaagcagattcccgaacaagcgatcccgcggcgcagctggaccctatcccttccctgctgccaaggctgctaggggctcaagctttggtccgcgtttccagaacccagtctcacgttccttaaactacgcacctcatgctggatatataaacccagcagctgcatcaccattctctgtccctgggagcgtgtcggggagacgaggtggtgtaccatatggcggacctggagccacgtatggtggctcccctagctttgcaaccggtggtgggcagcaaccattccgtcgttag

SEQ ID NO: 255 - DNA, 1695 bp, Zea mays
atgggacttagaataaatgatcttccatcttcaagtcgcactgtgcagactctaggttatagagttgggaacccaggaacctcgcatgctccctttgttcattttcatgctggaagttctggtagccatttaccagaccctgctgtgaattatccacataggtctgaggaaggcttcgctccagtgggttcccatatggacaacagaagggctgcaatgaagcgaaaaggtcccagtgtacaccctgcagggatcagtgctactggttattatgttggaagttcttccagtactcagccatctaactctgtgcagccaaatgcagctccacttgctgagccctttctccgtcaaatacctttaagcattgaccaaagtggttgggatatccaacacttgattcaccaagaagggtttcagaggaatgtgagagcacgccacagtagtattccattagtacccagatcagcttcaacatacccattaaacataaacagtgttcatgtgccgtcattcggttcaaccgcaagtgcttcctcaagtgcaccagtggaaatgaaccaagtgcctgtttctttgccaacaagaactctaccatcaggtgcaccaggtatgactagcagggtcccaacagggagggcttactatcctgtggttggaagcagcagcagcagctcaagtgttggtgctgtcccaactatccacggatcatctggcgctgcaatgtttgctaacggtggctatgttcctagtagtgttcatgctggaactgttccgatcttccctaacccagcgcctgctacttcatctggctccagagccatgccccaccagatggtcattcagagtcatccagctgctacttccgcagcaacatctacatccatgcggaccgcccaaccatcattacctgccagaaccgcagcggcttccagacatgcaaggcatgtgtcagcagggcttgccaacaacggaaggtacagaagggccaggagctcttactacaggcttcatccattgatggtagaggcagaggtagatagcctttttcttccctactgtttcaatgaagttgagtttaagtctttgtcgaacctgaaactgatgttgctgctggtcgtgaagcggttcatgatggaccacttggtcttctacgaatcgagagcagcagctgctgacccccacagggacatgagactggacattgacaacatgagctacgaggacctgttggctctgggagaagctatgggcaatgtcaacacaggcctggccgatgaaaaagtttccgagtgcgtgaaagaagtggtctgctgcagttctgaccacacgcagatggaccaagacgacggaagctgcgccatttgcctggtatatttcatcaaacacgttcctgttaaagacacgcttattaccattactactcactcaaccatggcccccgaaatctgctggactctacttctactgaccgacggatgcgttcgttccccgacaggaggactacagagacaaggaggcgctgggaatactcaagtgcaggcacgacttccacgccggctgcatcaagaagtggctgcagacgaagaactcgtgcccggtgtgcaaagcggccgcggcctagtagggagggacacgccagatgaggaggaggaggagcaagcgactgttgcgctcgatccgattcatttttag

SEQ ID NO: 256 - DNA, 450 bp, Zea mays
atggcggaccagctcaccgacgaacagatcgccgagttcaaggaggccttcagcctcttcgacaaggacggcgacggctgcatcaccaccaaggaacttggcactgtgatgcgctcattggggcagaaccctactgaggctgagcttcaggacatgatcaatgaggttgatgctgatggcaatggaaccatcgactttcctgagtttctcaacctgatggcacgcaagatgaaggacaccgactctgaggaggagctcaaggaggccttccgtgtgttcgacaaggaccagaacggcttcatctccgctgctgagcttcgccatgtcatgaccaacctaggcgagaagctgacggacgaggaggtggacgagatgatccgtgaagccgacgtggacggtgatggccagatcaactacgacgagttcgtgaaggtgatgatggccaagtga

SEQ ID NO: 257 - DNA, 2712 bp, Zea mays
atggagtctcacaatggcgaggccaatgacttgcctccaccacctcctctgattgctggtgttgaaccacttaaagctgatgaaacaaagatgccattgaaacctaggagtctggtccagagaaatggatttggcagaaaggggcagccaataaagctgataacaaatcacttcaaagtttctcttgtgaatgctgaagaatttttctaccattactatgtcaatttgaagtatgaagatgatacaccggttgatcgcaaagggtcaggaaggaaagtgattgaaaaactgcagcaaacttatgctgctgaacttgcaaataaagattttgcctatgatggtgagaagagcctgttcacaattggtgctcttcctcaagttaaaaatgagtttactgtcgtggttgaagatttttcaactggaaagactcctgcaaacggcagtccaggaaatgacagtcctcccggaagtgacaggaaaagggtcagaaggccttacaatacaaagacctataaggtcgagctctcttttgcagcaaaaattcctatgagtgcaatctcacaggccttaagaggtcaggaatcagagcacactcaggaagcaattcgagtgattgacattattctgaggcagcactcagctaagcagggttgcctattagtaaggcaatcattcttccacaacaatccttccaattttgttgacctgggtggtggtgtagtgggctgtagaggttttcattctagttttcgagcaacccagagtggactttcactcaatatcgatgtgtcgactacaatgatagtgaaacctggtcctgtcattgattttctgcttgacaatcagaaagttggtgatccaagcatgattgattgggctaaggccaagcgtgcactgaagaacttgaggataaaaataagtccagcgaaccaagaacagaagattgttggtctcagcgaaagaacttgtcgtgagcaattattcacactgaaacataaaaatggtaacaatggtgactctgaagagatcactgtttatgattacttcgtaaagcagcgtggcatagtgctgcaatactctggtgatcttccttgcatcaatgtgggaaaactaaagcggccaacatattttccaattgagttatgcagtcttgtgcctttacaaagatacactaaagctttgaacacacttcagaggtcatcactcgtggagaaatctaggcagaaaccgcaggaaaggatgtctgttttatctgatgtgctgcaaagaagcaactatgatgcagagcccatgttgaaggcatgcgggattacaattgctagaaatttcacagaagttgatggtagggtattgcagccacctaagcttaaagctgggaatggtgaagacatttttacacgcaatggtagatggaacttcaacaataagaggctcattagagcttgtagtgtcgagaaatgggcggtggtaaacttttctgcacgatgcaatgtcagggatcttgtccgggatctcatcaagtgtggaggcatgaagggcattatggttgatgctccttttgctgtatttgatgagaatccttcaatgagacggtcacctgctataagaagggttgaagacatgtttgaacaagtgaaaactaagcttcctggagcaccaaagtttcttttgtgtgttctagctgaaaggaagaattctgatatttatgggccttggaagaagaaatgccttgctgaatttgggatcgttacacaatgtgtggcaccaactagagtgaacgaccagtatcttacaaatgtcctacttaagataaatgcaaagctgggtggcatgaattcgttgctccaaattgaaacatccccagcaattcctcttgtatccaaggtcccaactataatcttgggaatggatgtgtcacacggttctcctggacattctgatgtaccatctattgctgctgttgttagttctcgtgaatggcctcttatctcgaaatacagagcttctgtccgcacccaatcacctaaaatggaaatgattgactcattgtttaagccacgggaagctgaagatgatggtctgatccgggagtgtctgattgacttctacaccagttctgggaagagaaagcctgaccaagttatcatattcagggacggtgttagcgaaagtcagtttaatcaggtgctgaacattgagttgcaacaaatcatcgaggcttgcaaatttcttgatgagaaatggaatcccaagttcacgttgattattgcccagaagaatcatcacactaaatttttcattcctggaaagccagataatgtcccaccaggaactgtggtggacaacaaagtctgccatccaaagaacttcgatttctacatgtgtgcgcatgctggaatgatcgggactacgaggccaactcactaccacatcctgcatgatgagataggcttcagtcctgatgatctgcaggagctggtgcattcgctctcttatgtgtaccaaaggagcacaacagccatatcagtcgttgctcccatctgctacgcacatctggcagctgctcaggttggccagttcataaagttcgatgagatgtcggagacgtcctccagtcatggcgggcatacttcggcgggcagcgttccggtccaggagctgccgcgcctgcatgagaaagaaggctcgagctggtacgatgttaaatgttag

SEQ ID NO: 258 - DNA, 591 bp, Zea mays
atgaggtttctgaaagttgacaggaaaacagttgatcttgtcggtaatgagaaactgaaggccagtgcatctgttaagcaccttgctcttccttgtaacaaggcagcaacggcacaagttattccagacattatccgatgttatagccatggaggtcgaaccatcatcttcactgagacgaaggattctgcatcagagctttctggtaatactggtgttgctgtcatgctttatgagcccagatataagcacagtgtcagcagactagaaagggagtctggggttaaatttgagcatatctctgcgccacaacccactgatgtagcacaatctgctggcagtgaagctgcagatgccattgcgagtgtgtcagacagtgttattcctatcttcaggcagcaagcagagcagttgctaagctcttccagtctgtctgcagctgacttgcttgccaaagcacttgcgaaggcagttggttacacggacataaagaaaagatcattgttatcttccttggaggattacagtacactacatcttcaaactggcagaccgatgtggtcacctgggtttgctataacattccggtga

SEQ ID NO: 259 - DNA, 114 bp, Zea mays
atgatgcaattcaatgaatcagccagcgtgttctcatgctgtcagtcagggcaacaactaatatgcaatcagactttatgtacaatcatgcaaacaagactcctggtctgttag

SEQ ID NO: 260 - DNA, 2418 bp, Zea mays
atgccgcccgcaacagccatggcgccgccgtcccagcccccgtctaactcaggggatccgctgtacccggagctctggcgcgcctgcgccggcccgctcgtcaccgtcccccgcgtcggcgacctcgtcttctacttcccccaggggcacatcgagcaggtggaggcgtccatgaaccaggtcgccgggaaccagatgcgcctctacgatctgccccccaagctgctctgccgcgtgctcaacgtcgagctcaaggcggagacggacaccgacgaggtctacgcgcagatcatgctcatgccggagcccgagcaaaccgatgtgccggctgagaagccgagttctgcacctgctgcgtcgccgaggccagcagtcaggtccttctgcaagacgctcaccgcctcggacaccagcacacacggtggcttctctgtgctgcgccgacacgctgacgagtgcctccctcccctggatatgacccagtcgcctcccacacaggagctggtggcgaaggatctgcatggcatggagtggcgcttccgccacatctttagagggcagccaaggaggcatctccttcagagtggttggagtgtttttgttagttctaaaaggcttgttgctggtgatgccttcattttcctcagaggagaaaatggtgaacttcgagttggtgttaggcgggcaatgaggcaattgtctaatgtaccttcttcagtcatatctagccaaagcatgcacctcggagtccttgcgactgcatggcacgccattaacacgaagtccatgttcactgtctactacaagcctaggacgagcccttcagagttcatcataccgtacgatcaatatatggagtcggtaaaaaataattattctattggcatgagattcaggatgaggtttgaaggagaagaggcgccagagcagaggtttactggtacaatagttggttgtgaaaatcttgacccactatggcctgattccagttggagatacttgaaggtgcgttgggatgagccttctactatcccgcggccagatagggtctctccttggaagatagagcctgcttcatcgcctcctgttaatccactcgtgcattcttctagagcaaaaagacctagacaaaacgttcctccaccttcacttgaatcatctgttctcacaaaagaaggtgcaaccaaggtcgaaatcgattcagctcaaacacaacaccaaaattcggtcttgcaaggtcaggagcagatgaccttgaggaacaacctgactgaaagcgctgattctgattccactgttcagaagccgatgatgtggtccccatcactcaatgggaaagcccacactcattttcagcagagacctgctatggataattggatgccattgggaaggcgtgaaaatgacttcaaggacacccgttctgccttcaaggatgcccgcaccgcctctcaatcatttggagatacacagggtttttttgtgcaagcttatgatgacaatcatcaccgtctctctttcaaaaatcagggttcaactcatcgcttcgcagatccgtacttctatatgcctcaacaatcgtcagtgacggttgaatcaagcacaaggacacaaacagcaaacaatgacttgtgtttctggggtgaccagaatgctatgtacggcaatccaagtgaccaacaacagggtttcaactttggacaaaacccatcaagttggttgaaccagccatttccccaggttgaacagccacgagtggtcaggcctcatgcaacggttgctccatttgatctggagaagactagagaaggaagtggcttcaagatttttgggttccaagttgatacaaccagtccatctcctgtccaattgagctctccattgcccgctatccaggagcatgtgttacaaactcgaccatcggcaccggtgaatgaattgcaacctgtgcaaattgagtgcttgcctgagggatctgtaagcacagctggaactgcaacggagaacattcagcaagccccgcagagttcaaaagatatccaaagcaagtcccagggtgcttcaacaaggagctgtacaaaggttcataagcaaggagtcgcacttggcaggtcggtggacctctctaaattcaccgactacggcgaactccaagcagagctggacaagatgtttgacttcgagggtgaattggtatctggcagccaaaactggcagatcgtctataccgacgacgagggcgatatgatgcttgtgggagacgacccgtgggaagagttctgcagcatagtgcgcaagatctacatctacacgaaggaggaggtccagaagatgaactcgaaatcagctgcgccaaggaaggaggaatctccggcagcgggcggcggaggaggttgcgccgccgccacaaacgagtag

SEQ ID NO: 261 - DNA, 1461 bp, Zea mays
atgcttataaagaagaaacttgctcagcagcagcaactattacaacagcaaagcaatagccaacagctcccacagcaacatcagcttcagcaacctgctgtctctagccagcaatctcaaagttcaaatcaacatcttcaacaagaaaaactaggaattggaagtatgcctgttgatgggggcataccaaactcatttgggggagctgaacagacagcgaaaaagagaaagaagccaggctcatcctctggtagagccaatagttcaggcacagccaatactgctggtccctctccaagttctgcaccctcgacaccttccactcatacaccaggagatgcaatgtctgtgccacagctgcagcagaatggcggttcagctaaacccatggtaatgtttggctctgatggaactgggagcttgacatctccagcaaacccattggatgatgtggaccgtttgctggaagatggctcattggatgataatgttgaatcttttctatcacaggatgacatggatcctagggacaacttggggcgatgcatggatgctagcaaaggttttggtttttctgaggttgccaaagcacgtgcaagtgcagccaaagttgtctgttgccacttctcagctgatggtaagctgcttgctactggtggtcatgataaaaaggttactttgtggtgtacagattctctgaagcctaaatccttcctggaagagcactcgtttcttatcactgatgttagatttagcccaagcatgtcgcgccttgcaacatcctccttcgacaaaactgtgcgggtttgggatgcagataacactgactattcactccgaactttcacgggccattcagcatctgtcatgtcacttgattttcatccaaacaaagaggatatgatatgctcctgtgatggtgatggggaagtgcgcagctggagcataaataatggtagctgtttgacatgtgttaaggtgtttaaggcaggtgctactcagatgagatttcaacctcgtaagggaaagtatctagcagctgcctcagagaaagcaatctacatacttgatggggagacacaacatgcttgtagaagccccttgcaggggcacaataagaatattcaatcgctttgttgggactctgctggtgaatatctggcttctgtcagtgaagactcagtcagaatatggtcattcagttctggacgtgatggtgaatttgtgcacgaattgaatcgcagtggaaatcagttccactcatgtgttttccacccaacttatcaatccttgttagtgattggttgttacgagtccttggaactttgggacataagggagaagaacaccatgaccttcaacaatgcgcatgacggtttggttgcagccctggcagcatccagtgcaacagggaaggttgcctcagtaagccatgataggactctcaagctctggaaatga

SEQ ID NO: 262 - DNA, 1524 bp, Zea mays
atggcctccccggcgccggcgtcccccgcggccgcggcggcgcactgccccccgccgcgcatcgggctcgcgggcctcgccaccatgggccagaacctggccctgaacatcgccgagaaagggttcccgatctccgtctacaaccgcaccgccgccaaggtggactccacgctgtcccgcgcgcgggacgagggctcgctgccggtgctgggccaccgcgacccgcgcgggttcgtgctgtccctcgcgcgcccgcgcgccgtcgtgctgctcgtccaggccggccccgccgtcgacgccaccatccaggccctctccccctacctcgagcccggggacgccatcgtcgacggcggcaacgagtggtaccagaacacggagcgccgcatccaggaggcggcggcgcgcggcgtcctgtacctcgggatgggcgtctccggcggcgaggagggcgcgcggaacgggccctcgctcatgcccggcggcagcgccgacgcctacgccaacatcagggacatcctccagaaggccgccgcgcagacggaggacggcgcctgcgtcaccttcgtcgggcccggcggcgccggcaacttcgtcaagatggtgcacaacgggatcgagtacggcgacatgcagctcatcgccgaggcgtacgacgtgctccgcaggctcgggggcctgtccaactccgagatcgccgatgtcttcgctgagtggaacaggggggagctcgagagcttcctggtccagatcaccgccgacattttcaccgtggctgacccgttggacgggagcgggagtggcggcggggcgctggttgacaggattctggacaagactgggatgaaggggaccgggaaatggaccgtgcagcaggcggcggagcttgcggtggcagcgcccacgattgccgcgtcgctggacgggaggtacctgtcagggttgaaggacgaacgggtcgcagccgctggggtgctggaggaagaggggatgccggcgggcctgttggagacggttaatgtcgacaagaaggtgctggtggatagggtcaggcaagcgctctacgcctccaagatttgcagctatgcgcagggcatgaatctgctgcgagccaagagcgtggagaagggatggaaccttaacctcgcagagcttgccaggatctggaagggcggctgcattatccgtgcgaggttccttgataggatcaagagcgcgtacgacaggaatcctgagctcgccaatttgattgttgacagagagtttgcaagggagatggtgcagcggcagaacgcgtggaggtgggttgtggcacgcgcggtggaggctggcattagcacgccaggaatgactgctagcctttcgtacttcgatacctacagatcaagtcgattgcctgcaaatctgatccaagcgcagagggatctgtttggtgcacacacctatgagcgcattgactgtccgggttcattccacaccgaatggaccaagctggcgaggaggagcaatggcgcagccatttga

SEQ ID NO: 263 - DNA, 1929 bp, Zea mays
atgcttaaaccctcgccgggaggaggactccacgcgcgagcccgcccgcgccacctaccgccgcgcccggatccccgccatggccgccgcgccgcaccgggcccaggtccccgctgcacggctccgttgcagacggggcctgtacttgagaataacccctccaagagtgcaaacgccaaggaccagattctttctggtacagagaatgtgactacaggcaatgcacgtggcgctagctccttgagatcgccaaacggcccaccagagaaggctagctctgtcggaaaagctggagagcaaccttatctctaccagcaaaatgtgtatgcaccacagccacaaccactctatcctggaggatacatgaacccttcaggacaatgggaggaatatccccattatgtgaatatggaggggctccattccgtatctcccgtaagttgctggaattaccgagcttctttgtgttttcttgatttttttctaaatatttttttcttgaagggaatctacaatgacaaccagtccctcatgctatctgctggatatgcaaacaacccccaaatgatgtatggagcatattctcctgtttccactgctggagatggccaacaatacttccctgtgcactattccttctcaaatccttactatcaaccaccagcttctcctagcatgggatattcaaactccgcaactggaatgtcccaaggagaccctatgctgcagcaagagtatttccttcctgatggccttctatattcacccacaccagggtatcatcaaccattcagctcatttgacagagcactgacacagccaaataatgctcctgggttgtttggtcaagggagtctaccactggcttctggaatgcatcatggatcgatgtatggtcctggatcctacaagggacgccagtatggtagcaaatttggtggcactactccaagttggagttctgctggccgcagatttggtactttcgacttgagtggcaatcaacaaagggggagcatgtcatttggtagtcataatggctctctggagtttatgaatgagcaaaaccgtgggccacgtgctacaaaaccaaagatacaagacacagagaactcaggagatgagaaaagcgagaaaactgttcctctaattgatagtgaactgtacaatcgctctgattttatcactgagtacaaggatgccaaattctttgtaataaagtcctacaccgaggaccatgtacataggagcattaaatataatgtttgggctagcacagccagcggaaacaggaagctggattctgcttaccgtgcggccagagagaaagaagagcattgccctattttcttgtttttctcggttaatggaagtggccaattctgtggcgtggctgagatgattggacctgtcgattttgacagaagtgttaattactggcagcaggataagtggagtggccagttcccagtgaagtggcacataattaaggatgtaccgaacaaccttctgcggcacatcattcttgagaacaatgacaataagcctgtcacaaatagcagggacacccaggaggtgaagctggaacagggcctccagatgctaacgatcttcaagagccatgaggctgagacaacaattgtggaagatttcgacttctatgagcagcgggagaaagccttgcaggagaacagacgtcaacagcatgctgccagcaccgatacccagaaactggtggataccaaggctcaagatgctgtggccgacatatcagatgcatttgccaaggccgtccagttgaagaatactgagaacagtgggacaacccccaaaactgagggtgcttcagctgaaaagggttccgctgccacagccaaggttgaaggaagtgcaaacctgaacacaggccctgtggaggaaagcagttga

SEQ ID NO: 264 - DNA, 2412 bp, Zea mays
atggtcggcggcggcaacgagttccgtttcttcttgtcctgcgacatcagccacccgcttgccttccgtgttctccacgcagaacatatcttgttgaccgaccaaaaagtcccagagctctttgttgagtgcaagctatacatcgatgggatccaatttgggttgcctgtaaaaacaaggttggaaccttctggaccgaaatactgttggaatgagctcataacattaagtaccaaatacagggacctaacatccctctcgcagcttgcatttacggtgtgggatgtctcatctggtgagaaccctgaggttgtcggtggagccaccatatttctttttaacagcaaaaggcagcttaaaacaggaagacagaagctgcggctgtggcccacaaaggaggcagatggaggagtccccaccacaactcctggcaaggttcctaggaatgagaggggtgagatagaacgtttggaaaggcttgttaacaagtatgagagagggcagatacaacatgttgattggcttgatcgtcttgccttcagtgctatggacaaagctatggaaaaagagtgtgagaggaaggccaatttgtaccctagtctggttgttgaattgtgcagtttcgaacatagaattgtcttccaggaatctggagcaaatttttatacaccggccccagtatcattatcaaatgaactggttactgtatgggaccctgaacttggaagaaccaatccatctgagcacaagcagttaaagcttgctaggagcttgactcgtgggatagttgatagagatctaaaaccaagctcaaatgagagaaagttactacaaacaattattaagtttcctcctacacgcaccttggaagtggatgagaagcaattggtgtggaagtttcgtttctctttgatgtctgagaagaaagctctaacgaaatttgtccgctcagtggattggagtgataaccaagaagctaagcaagctgttgagttgattggaaagtgggaaatgattgatgtggctgatgcactagagcttctctcacctgattttgaaagcgacgaagttcgtggttatgctgtcagcgtacttgaaagggctgatgatgaagaattacagtgctatttactccagttagtgcaagctcttcggtttgaaagatctgacaagtcccgtctagcactctttcttgtaaaccgtgctttgtccaacatcgaaattgctagcttcctccggtggtatatattagttgagcttcacagtcctgcatatgcaagacgatattatggcacatatgacatgcttgaaaacagtatgatgaaattggttggtagggaggatggggatgaagatggatttcgactgtggcagagtttaacccggcagacagacctcactgctcaattgtgttctattatgaaggatgtaagaaatgtaagaggtagcgcacaaaagaaaattgaaaaattgaggcagctattatcaggagttttcagtgagcttacaaactttgatgagccaattcgttcaccattagcaccaactcttctcctaacaggagttgtgcctcaagaatcgtctatatttaagagtgccttgaaccctttgcgcctgacatttaaaacagcaaatggcggaacatccaagattatttacaaaaagggtgatgacctccggcaagatcagttggttattcaaacggtttctttgatggaccgactactcaaattagaaaatctagatttgcaccttactccataccgagttcttgcaactggacaagatgaagggatgcttgaatttattagttccagttctcttgcacagattctatcagaacatcgcagtattacaagttacctacagaagttccatcctgatgaggatggtccttttggtataacggctcaatgtttggagacattcataaaaagctgcgccggttactctgtcattacatacatattgggggttggagacaggcatctggataatcttcttctaactgatgatggacgcctttttcatgttgactttgcttttatccttgggcgagacccaaagccatttccgccaccgatgaagttgtgtaaggaaatggttgaggccatgggtggtgcagaaagccaatattacacaaggttcaagtcctactgctgcgaagcatacaacattctgaggaagtccagcagtctcattttgaatctattcaagctgatggagcgatcaggcattccggacatctctgccgatgaaagcggaggtctcaagctccaggagaaattccggttggatctggacgacgaggaggctatacatttcttccaggatcttatcaacgatagcgtgagtgctctgttccctcaaatggttgagaccatccatagatgggctcaatattggcggtaa

SEQ ID NO: 265 - DNA, 270 bp, Zea mays
atgtactgggacgacaaatatggtactcatagtgtatcagctgaggttgttgccagaatgagggacatggtgagtaatgacatgcaaaatcctgtctctaattcatttcttttagatgatgacttaagcattcctttcacaaccgaggaaattgcagagcaagtaccagatgttgacatgtcaaacatcgaaactcccgcatctcttcgtcatgttcattctgctcagttcttgacgcagcaccttcagccaccttatacgtctcgatga

SEQ ID NO: 266 - DNA, 474 bp, Zea mays
atgaagggggccaaatccaagggcgccgccaaggccgatgccaagctggcggtgaagagcaagggggcggagaagcccgccaagggcaggaaagggaaggccggcaaggaccccaacaagcctaagagggctcccagcgctttcttcgtgttcatggaggaatttcgcaaggagttcaaggagaagaaccctaagaacaagtctgtcgctgcggtggggaaagctgctggcgacaggtggaaatccctgagcgagtcggacaaggctccctatgtagccaaggctaacaagctcaagctcgagtacaacaaggccatcgctgcctacaacaagggcgagagcactgcagctaagaaggctcctgccaaggaggaagaggaggaagatgaagaggagtctgacaagtccaagtcggaggtcaatgacgaggatgatgaagagggtagtgaggaggatgaagatgatgacgagtga

SEQ ID NO: 267 - DNA, 738 bp, Zea mays
atggtgatggcgtcgtcgagcgggctgaggagctgcagcgccgtgggcgtgcccagcctgctggcgccgtcgtcccggtccggccgcctggcgccgttctgcgccaacgccaccacctctggccgcgtcaccatgtccgcggagtggatgcccggccagccacgccctgcccacctcgacggctcctctcccggggacttcggcttcgatccgctgggcctcgcgaccgtgccggagaacttcgagcggttcaaggagtcagaggtgtaccactgccgctgggccatgcttgccgtccccgggatcctggtgccggaagctctgggcctgggcaactgggtgaaggcgcaggagtgggcggccgtccccggcgggcaggccacgtacctgggcgccccggtgccgtggggcacgctgccgaccatcctggtgatcgagttcgtggccatcgccttcgccgagcaccagcgcaccatggagaaggaccccgagaagaagaagtaccccggcggcgccttcgacccgctcggcttctccaaggaccccgccaagttcgaggagtacaagctcaaggagatcaagaacggccgcctcgccatgctggccttcgtcggcttctgcgtccagcagtcggcgtaccccggcaccggcccgctggagaacctcgcctcccacctcgccgacccgtggcacaacaacatcggcgacatcatcatccccagatcaatctccccttga

SEQ ID NO: 268 - DNA, 2301 bp, Zea mays
atggctgcggcggcgatcctgccggagctggcgacgcaggtgctcatcccggtcgcggcggccgtgggcatcgcgttcgcggtggtgcagtgggtgctggtctccaaggtgcgggtcacccccgagcgccgcgcggacggcggggccgtgaagagcgggcccagcgactacctcatcgaggaggaggagggactcaacgaccacaacgtcgtcgtcaagtgcgccgagatccagaccgccatctctgaaggagctacatctttccttttcactgagtacaagtatgttggattattcatgggcatctttgcaatccttatattcctcttccttgggtctgtcgagggattcagcacgaagagtcaaccttgccactatatcaaggaccagacttgcaagcctgcccttgctaatgccatcttcagtactatagcttttgtgcttggtgcagtcacctcactagtttccggctttcttggaatgaagatcgcaacttatgcgaatgcccggacaactttagaggccagaaagggtgtcggaaaggcatttattactgccttccgagctggtgcagtaatgggcttcctgcttgctgccagcggtcttttggttctttacattgctatcaatttgtttggaatttattacggtgatgactgggaaggtctttttgaagctattactggttatggccttggtggttcttctatggctcttttcggccgcgttggtggtggtatttataccaaggctgctgatgttggtgctgaccttgtggggaaggtagaaagaaacattcctgaggacgatccaagaaacccagctgttattgctgacaatgttggtgataatgttggagatattgctggaatgggatcagatctctttggctcatatgctgaatcatcatgtgctgctcttgttgtggcctctatctcgtcttttggaatcaaccatgaatttactccgatggtgtaccctcttctcgtcagttctgttggtattatagcatgtctcataacaacgctgtttgcaactgatttcttcgagataaaggctgtggatgaaatagagcctgctctcaagaaacagctcataatttccacaattgtgatgaccattggcattgcactaatcagttggcttggtcttccatacactttcactattttcaactttggagtccagaagacagtgcaaagctggcaattgttcttgtgtgtggcggttggtctctgggctggcctagtcattggttttgttactgagtactacacaagcaatgcctacagccctgtacaagatgttgctgattcctgcagaactggagcagctactaatgtcatttttgggcttgctttgggttacaaatcagtcattatcccaatttttgctattgcgtttagtatcttcctcagcttcagccttgctgccatgtatggtgttgctgtggctgctcttggaatgctgagcaccattgccacaggtcttgctattgatgcatatggccctatcagtgataatgctggaggaatagctgaaatggctgggatgagccataggattcgtgagagaactgatgctctagatgctgcaggaaataccacggctgcaattgggaagggttttgccattggctctgcagccttggtttcccttgcactatttggtgcgtttgtaagccgggctgctatctccactgttgatgttctgactcctaaagtattcatcgggcttattgtcggtgctatgctcccgtactggttctcggcaatgaccatgaagagtgtgggcagtgctgcgctcaagatggtggaggaagttcgtcggcagttcaacaacatccctgggctcatggaaggcaccacaaagcctgactacgcaacttgtgtcaagatctcaacggatgcatccatcaaggagatgatccccccaggtgctcttgttatgctcacaccactgatcgttgggattctatttggggttgagaccctctctggagtccttgctggtgcccttgtctctggtgttcagattgccatttctgcatccaacactggtggtgcctgggacaacgccaagaagtacattgaggctggagtttcagagcatgccaggacccttggcccaaaaggttctgaccctcacaaggcggctgtcattggtgacaccattggagatcctctcaaggacacgtctggcccttccctcaacatcctcatcaagcttatggcggttgaatcccttgtcttcgcccccttcttcgccgcccatggtggcattctcttcaaatggctctaa

SEQ ID NO: 269 - DNA, 5790 bp, Zea mays
atgcaggaggagctagggcaaaggatgcatgtacctcatggtatcaatctgtgtttctcaacttcttccgagctctttcaggtggaatcttccattgagctgggtactgcagaagtgaaccctgtaccatctgaaaagttatctgctaactcacaagctgttagagatgatgctggagcagttgaaggtattgacatgaatggaaaacctgtccaaaaacctaagaggaaaaaacataggccaaaggtcattaaagaaggacaatcagcaaagttgcagaagcctaaaactccaaagcctcccaaagaaaatgggaatcagcctactggaaagagaaagtatgtcaggaagaagggactaagcacaccagccaaacaaattccatcagaaggtgctgatacacacactagagctaaaccaggaatagcccaaagatgtttggactttgatgtggaggaccaacatggacatttggatctggtatcacaaacccaggaaacggagatacagactggtcctggggacacacagccatcaatatctggagttgaaagaagtaatgcccaggtatcatgccattggggttggggtggtacaagcagttctattatttcagctgacccaatagttgatatacaaggattacaggcagactgcatacctaaaagagtcaattttgatttgaacaattctatggcaagtcagatgccaaccaattattctagtcgaatggacagctctggacaatttttccagtttggtttaggagaaaaagttcaaacaaatcagttactggattataattgtaatctgccagctagacgtgtctctcatctcagcagctcggtcgatcatatgcgacaccccttagccaattttgaccaatacataagcacatctcaagtttgtacagaaaattcacgcagacattatcagatgcctagtagttctagaatttcagaaaataggacagcagcttctcagtatactgaaagggtgtcaatggggggcaatttcaatcccggagcttgtataggagaaggcacggtaatcaaacaaatggcccaatgttatagacttccagaaagtccacttgtacctcccaaacataatgaaagggatgtgatgaatggaaatctaaacgagttttctgtgtataatgattacttgaatttttctagcaatagtaactaccaaactggagcagcttttggttttcatgattctccagtctattcagatgttcttgcaatgggtaaaaaaagagaacacaatgctatcagtggtcaccagatttcttttgacatcgactttgttaactcaaatagtacaaggaagttctgtattgatgaccttctttccactagctctcaaacatcttattatcctgaagcatgcaaaaggatgagaccagagaatcatagcaatcagctcaatgtaactacgggaaagctttcttcttcatcagcattttctggtagtttgaatacaaataacgtttcaactataaaccctggaattggtaccttggctgatatacaaaggttgatggcccttgagaaatcacaagcttcacaacaaatgattgactttattacgtcgcaaaacaacatggccggtgaaagtactgaacttgctcagcaaaataattctgacaaaggatttgttgctttacataataaaaagttccaaagcctcactgcgcagaacataccattgcctgacagtactgtgaaccaatcgggagaaagtaatatcttgaggaatggaatacatcaaacacaaccttgggaaattacatctaggtcgcatcactctagcgacaattttgctttgccaaataaatggtctggttacttgacagcagggaacacacagttatcaagcatcacagtaaacccatccacagaaaactatattcaaagtaatgctatttatcaatatcaatgtttagaaaacgttgtggctaaggtgccagtattgtctggaacacacaatacttccagtcaggagggccataaccacagcactgctgctactaatgagcatatcagaactacaagtgaggaagttgttagatcctttacccaacgagcaagtgaaccaaccacacatgggaactacaatctcaactcttctagagtaactgcagaagcaaactccactgagaagccaagaaaaaggggccgtccaagaaaagtagtaaaacccaatggggagccaaaagaaagaggtactaaagggaaacaaaatgttagtcatgaaaaacctacatcgcaaaaaggttcacatactgacattttgaaaactaatggtatttcttatgcttctgaaccttccactggaattactcctaggatggctattgtggagtcgaaaagctctgatcaagataaggaaattcatggaggtgtcattcctcaagctacagcaatatcagttgatcttttagatggcataattcaaaagattaagctcttaagcataagcagaccagacaatgttgtggcagagataccaaaagatgctcttgttccttatgaaggtgaatttggtgcactggttgcatttgaggggaagacaaagaaaaaccgttctcgggccaaagtgaacatcgatccagtcaccactatgatgtggaacttattaatgggaccagatatgggtgatggtgctgaagggttagacaaggataaagagaagtggcttgatgaagaaagaaaagtgttcagaggacgtgttgattcattcattgctcgtatgcatctagttcagggggacagacgtttctctcgatggaaaggatcagtcgtggactcagtcgtgggtgtatttcttacccagaatgtttcggatcatctttctagttctgctttcatggcggttgctgccaaatttcctgctaagccagaggtccctgaaaaacctgtggctgagatgtctcatactcctgaacagaaggatagttgctcttgctctggactgtttggtgattctatcaaattgcagggcaagatgttcattgaagagataagtgatgttagatcattaattactacagaagataatgaagaaagtaatagtaatgaattgattggaagctctgccgggtatggagtaaaccatgcaactggaggctgccatgtttcttataggaagtcactaactgaatcccatgaaaatgggctttcaggatctgtttttccaactaccggcttttcaagtgtagtagaaactgaagatggctcattagaggatgttatttcttctcaaaattctgctgtttcttcccagaattccccagattacctttttcacagaacggatccaataggttctagttcgttgcaaaatttcaccgaagagggctatatcatgagaaatatatccaacgggactggcagctcaactgactgctcagggtttctgccaattcaagatccaaaaggcacgcttggattgtcagaatattatggacataatcctcttctagtttcaggtgtgaacaagggtgtgttgcttgatctaaacagatcatatcagccattacatacttctatgccctatgttcagaatagcgagtctgatttcacaggtgtgtcatgtttcagccatatggataaatcattccacacaggccctaatagagtgaatctttctagtgttacacaatctgaggccagtctttaccctactgatcctttgcaacaagacgagttttcaccagtaattaaacaaaacttccaaccattatatagttcagacaaagtgtcattattcaaggagcactgttcctatggaaatgatttttcgaggaacaaaactgaagctgctattatggaaccacttgtctactcaaatcctcaagagctgtacactacctcaacagagcaaatgggtgttgaacaatttcaatcaggatgtggccaacaggacaatgatgtgagagttcagacaacatcatatgaaaggcatcagtcttcaaccttgtgtggaaaccagaactctcagttagagatcttgcaaggagttgcttcaggctcaacacagaagttcattgatactcaaaagagtccgtcagaagttcaacaaaacggatcaaaagctaagaaggtacggggtcgacctaaaacgaaaacttatgactgggacagtttacgaaaagaagtgttttctaatggtggggataaacaaagaaataatgatgcaagggatactgttgattgggaggcagttaggcaagcagaagtccgagaaatatctgaaactatcagagagagaggaatgaataacatgctagcagaacgaataaaggaattcctgaaccgattggtgacagaccatggaggtattgatcttgaatggctaagagatgttccaccggacaaagcaaaggacttccttctaagcattagagggcttggactcaaaagtgttgagtgcgttcgtctcttgacgctacatcatatggcttttccagtggacacaaatgttggtcggatatgtgtgaggcttggatgggtgccgcttcaaccattgccagagtctcttcagttgcacctattggaaatgtatcccatgctggagcacatacagaagtacctttggcctcgactatgcaagctagatcaacgtacattgtatgagcttcactaccaaatgattacttttggaaaggttttctgcacaaaaagtaagcctaattgcaattcatgtccattgagagctgaatgtaagcactttgctagtgcatttgcaagtgctaggcttgctcttcccgcacctgaagaaaaacgtttggctacatcggaggatccaaatgttgtagagttttgtcaccaaacatacataaattcaggggctgttggcgaacttgagtggagtgcgaactatcctaagcatgctgtttgtggtaacctgcagccgttcattgaggaaccactgagcccagaacctgaacctgaaaatgtagaggcgaaggacggtgcaatagaggatttctttaatgaagaccctgatgaaattcctactattaatcttaatattgaggagtttacacagaacttgaagaactatatgcaagcaaaccatgttgagattgagtatgctgacatgtcaaaggcattggttgccatcacccctgaagctgcttccattccaactccaaagctcaagaatgtcagtcgtcttaggacagaacaccaagtttatgaactgccagattcacaccctcttctggaaggatttgaacagagagaaccagatgatccctgtccatatcttctttccatatggaccccaggtgaaactgcacaatcaaccaatgcgcccaagacattctgtgattcaggggagactggtcaactatgtggaagtttaacatgctttagttgcaacagtttacgagaaatgcaggctcagaaagtcagaggaacactcttgataccatgccggacagcaatgagaggaagcttcccacttaatgggacatattttcaagttaatgaggtatttgctgaccattgttcaagccaaaatccaattgatgtcccacgaagttggatatgggacctcccaagacgaactgtttactttggaacctcagttcctacaatatttagaggtttaacgactgaagagatacaacaatgcttttggagaggattcgtttgtgtgaggggctttgataggacagtaagggcaccaaggcccctttatgcaaggttgcattttcctgccagcaaggttgttagaggcaaaaagcctggagcggcaagcgtcgaagaataa

SEQ ID NO: 270 - DNA, 1026 bp, Zea mays
atggccgcagccatcgacatgtacaagtactacaataccagcgcacaccagatcccctcctcatccccctcggatcaggagctcgcgaaagcactcgagccttttataacgagtgcttcctcctcttcatcctcctccccctaccatggctactcgtcctctccatccatgtcccaagattcttacatgcctacaccctcttacaccagctacgccacctcgcctcttcccactcccgccgccgcctcctcctcgcagcttccgccgctctactcgtcgccttatgcggcgccgtgcatggccggccagatgggcctgaaccagctcggcccggcccagatccagcagatccaggcccagttcatgttccagcagcagcagcagcagcagaggggcctgcacgcggcgttcctgggcccgcgggcgcagccgatgaagcagtcagggtcgccgtcgccgccgccgccgctggcgccggcgcagtcgaagctgtaccgcggcgtgcggcagcgccactggggcaagtgggtggcggagatccggctcccgaagaaccgcacgcggctgtggctcggcaccttcgacaccgcggaggacgcggcgctcgcctacgacaaggcggccttccgcctccgcggcgacacggcgcgcctcaacttcccggccctccggcgcggcggcgcgcacctcgccggcccgctgcacgcctccgtggacgccaagctgaccgccatctgccagtccctgtcggagtccaagtccaagagcggctcgtccggcgacgagtcggccgcgtccccgccggactcccccaagtgctcggcgtcgacgacggagggagagggggaggaggagtcgggctccgccggctcccctcctcctcctcctcctcccccgacgctggcgccgcccgtgccggagatggcgaagctggacttcacggaggcgccgtgggacgagacggaggccttccacctgcgcaagtacccgtcctgggagatcgactgggattccatcctgtcatga

SEQ ID NO: 271 - DNA, 684 bp, Zea mays
atgggtcgtgagtgggaacttagtttccgtctgggtatgcgcccttggattgctgttgcatattcagctcctgttgcagctgctactgctgttttcttgatttaccctattggtcaaggaagtttctctgatggtatgcctttaggaatatctggtactttcaactttatgattgtattccaggcagagcacaacatccttatgcatccatttcacatgttaggtgtagctggtgtattcggcggttccctattcagtgctatgcatggttccttggtaacctctagtttgatcagggaaaccactgaaaatgagtctgctaatgagggttacaaatttggtcaggaagaagagacttataatattgtggctgctcacggttattttggtcgattaatcttccaatatgctagtttcaacaattctcgttctttacacttcttcttggctgcttggcctgtagtagggatctggttcactgctttaggtattagtactatggcattcaacctaaatggtttcattttcaaccaatctgtagttgatagccaaggtcgcgttattaatacttgggctgatatcatcaaccgtgctaatcttggtatggaggtaatgcacgaacgtaatgctcacaacttccctctagacctagctgctcttgaagttccttaccttaatggataa

SEQ ID NO: 272 - DNA, 2388 bp, Zea mays
atggagcaggacccggagcgcgcctgccttcggagcttcgagctccacgagagcgagtcgagcctttacgttctaggaactaattctgacagaacactttggagactactcaagatcgatagatcagagccgtcagagcttgtgatagacgagtgttctactgtatatactgaaagtgaacatcctgacttgttgaagggtcttgatgacgagcacaggtcaactggcggagtaaaatttgttacaaagttttatggcataattggttttatcaaattccttgggccatattacatgttgattattactgagcagaaaaaaatcggggaaatctttggtcatccagtgtatcaggtgaccaggacttcaatggttgaattagcaaattctaagacaagatctacttttcaaaacttcaaggacgagaacagatacaggaagatcttgaatgcacttgatcttaggaaggatttctttttcagttactcataccacattatgagaagtcttcagaagaacttggctgatccacaggatggatggaccttatacgagactatctttgtgtggaatgagtatctgacacggcggatccgtaattgtctcagaaatactttgtggactgttgcattggtccatggtttctttaagcaggataaattctcaatatctggcaaggatattatgttcacactcatcgctagacggtcgaggcattatgctggaaccagatatttaaagaggggggtgaatgagaagggaagagtagcaaatgatgttgagactgagcaaattgtctatgaagctgtgcctggacctactgaagtaagttctgttgtgcagaataggggctcaattccactattctggtcacaggagacatcaaaattgaatcttaaacctgatataatattgcatgagatgcagaataattatgaagctacagagcttcattttgaaaatcttagagcaagatatggaaaccctatcattatcttaaacttgattaagacacgtgagaggcgagagtctatactccgccgagaatttgataaggcgatcaagataataaacaagagcctgtcagaagagaatcatctgaggttcttacattgggatcttcatcaaaactctcaaggaaaacctacaaatgtactcgacgtccttctaaaagtggcatttcgggctctgaatttaactgagttcttctattgtcaagtcgcaccaaattctgagacttctgcacaatgccccaccctattgaatggtcttgatcaatatttatgtgatgacaacaatagtgacgacacagaatgcactgagattgttggtgatgtatcccaagaggatatctcaggcagctctgattcctctggtaatgcaaccacagaagataaatttgagaatagtggactgccaccaccaaaaccaccaaaattccaaaaaggtgttttgaggacaaactgtatagattgcttggatcgtacaaatgttgctcagtatgcacatggtttagctgctcttggacatcaattgcatgcgcttggttttatagaatctccagaactaggtttagaagctcccttggcccatcatttgatgcacttttatgagatgatgggtgacacacttgctgtacagtatagcggttctgctgctcataacaaggtattctctgcaaagagaggtcacttgaagctttttattcagtcacaagagttctttaggacacttcagcggcactacagcaacacctgtatagatgctaacaaacaggctgctataaacttgtttttgggatacttccagccacagcaggaaaaacctgcactgtgggagttagaatcatctgctgggaagcataacaataatctttttgatggccacccaagtacattgaaaagagtaaaatcagatggcaccattcttcatgaaagtaatgcttctatatctggctctggtcgttgccataatgaacagttaagtgcatcgcagcctgatgtccagaatgggtttcaattcccaacttcagaatccgattcacttcatgaaaatgacatttcatcagcttgtggaagtggagtagcacacctaaggtatactcctacagcctctgacgtgcttcatgtcccaagagctaaagttgaatattgccatgattctggtgattcaaactttttggatcttgaatggctttccacttcaggcaactcaagtgatgaaaggtctattgcaactagcacgccagatgcaaacctatcaaatgagaatgtcattagtggcataactcctgatatcatggaaaaccatcttgctgaaatgcagtatcagaagttacctcggaattttgtgcagtgggttaatcacggtgataccttttggtactaa

SEQ ID NO: 273 - DNA, 1767 bp, Zea mays
atggtgaagaagcccaacggtgtcgccaaggccacggcgacctctgctgacgcggcagcccagccatccaaggagaatccgtccacccctgggttggtcaaggcctcgaagtttaagaagagaaaggtcaaggccaaccgtgcgaagcaggcagtcgctgcagcagctattgacgaggtcgcccctgtaggtgcaggcactggtgatggcgatgcatctgcatcagcggctttaccgcaaccatccgatgttgccgaggcattacttgtggtgcaaacgccaaagtcaaccacttttgctgaggcatcacctgtggcacagacgcagaagccagccactgatgctgaaggattggtgcctgcaccaataccaaccactgctgtagcatcagcttcgtcgccaaagccaaaaccagctcaagctaatgctgatgctgcagctgcaatttctgccagcaagggcaatggtgtgggtgctgataatagtaggggtgatggtgagatgaagaacaagaaagagagggccatgagtgacaaggggaaggaggttatggaggaaggaggaagtaagggaaagggtaagggtaaggggaagaaggctgtggtcaagaaggaagaaaggggtgaccgtaaggttgcagggtttatattcatgtgcaatgcaaagactaagaaggagtgctaccagagtcgcttgtttgggatgcctagtgggaagattgaaatggtcaagaagattaggccaggggtcaagctgttcctgtatgattttgacttgaagcttctgtatggcgtgtacaaggcagcatcacatggtgggctgaaccttgtccatgaagcatttaatgggaagttccctgcacaggttaagtttaagattgataaagattgccgtcctctccctgagagtagtctcaagcaagccatcaaggaaaattacaatgcaaagagcaaatttgatccagagctcaccacaaaacaagtccaaaggttacttttgctgtttaagcctgttagtgcacctcaatctgtttcaaataatcaccttggagaaaggcgccactatgaaaaacgaaggaagccacgccattttgaagaaaggcggcctattgaagcagcgcgtcggccacgatttgatgaggaaaggcgccctgcggttagacatgttccttttgaggatccatacagggcaccacgctatgctccagttcctgttgactctcagcatggccattctttggctagtgatcaccacagatattatcaaccagcacttacacctgagcctcggcagcttcctcttgttctagagcctcgatatgttccgccggccctagatcatcatcatgtgccagagcttcgacatgccccacctgcatattatcgcactttggctccatctggtgattcatactatcggtctgttgagaatctggtgcctgagcgatatgcagacagaaccatggctgacttgaccactagagatccaattattagggatcacacagcactaccaggggaggcacttgctcgagcagaccgcttggatgatctctaccgttctgatcgtgtggaggaactctaccgttctgatcgacttgttaaccgtgctgtggaccgccctcatccagcctattttacagctgcttatgagaccaaccctgcttatgctgaaacgagcattaggcctgtctctgcaagggtcaatggacccagtgcggcagtttcgtcactctattccttcagtggtggcccagtatatcggtaa

SEQ ID NO: 274 - DNA, 639 bp, Zea mays
atggccaaaatggtgttgctctgcgtgctcgtctccttcctcctgatgcccttggcctccctagccctgacgcaggacttctgcgtcgccgacctgacctgcagcgacacgccggcggggtacccgtgcaagtccagcgtcaccgccaacgacttctacttccacggcctggccggccagggcaaaataaacccactcatcaaggccgccgtgaccccggccttcgtgggccagttcccgggcgtcaacgggcttggcatctctgcggccaggctcgacatcgaggtgggcggcgtcgtgccgctgcacacccacccggcgggctcagagctcctcttcgtgacccagggcaccgtcgccgccggcttcatcagctccggctccaacaccgtctacaccaagacgctgtacgccggcgacatcatggtgttcccccagggcctgctccactaccagtacaacgccggcaccggcgctgccgtgggcctcgtcgccttcagcagccccaaccccggcctgcagatcaccgactttgcgctctttgccaacaacctcccgtccgccgtcgtggagaaggtcaccttcttggacgacgcgcaggtgaagaagctcaagagtgtgctcggcggcagcggttaa

SEQ ID NO: 275 - DNA, 1344 bp, Zea mays
atgggtaaagagaagtcccacatcaacattgtggttattggccatgtcgactctggcaagtcgaccaccacaggacaccttatctacaagcttggaggcattgacaagcgtgtgatcgagaggtttgagaaggaggctgctgaaatgaacaagcggtccttcaagtacgcgtgggtgctcgacaagctcaaggctgagcgtgagagaggtatcaccattgatattgctctgtggaagtttgagaccaccaagtactactgcacggtcattgatgcccctggacaccgtgacttcatcaagaacatgatcactggtacctcccaggctgactgtgctgtccttatcattgactccaccactggtggttttgaggctggtatctccaaggatggccagacccgtgaacatgctctccttgcgttcacccttggagtgaagcagatgatttgctgctgcaacaagatggatgcaaccactcccaaatactccaaggcacgttatgaagagattgtgaaggaagtctcatcctacctcaagaaagttgggtacaaccctgataagattgcctttgttcccatttctggttttgagggtgacaacatgattgagaggtccaccaaccttgactggtacaaaggcccaaccctgcttgaggctcttgaccagatcaccgagcccaagaggccttcagacaagcccctgcgtctgcccctccaggatgtgtacaagattggtggtattggaactgtaccggttggtcgtgtggagactggtgtcatcaagcctggtatggttgtcacctttggtccaactggcctgactaccgaggtgaagtctgttgagatgcaccacgaggcgcttcaggaggctcttccgggtgacaatgttggcttcaacgtgaagaacgttgctgtcaaggatctcaagcgtgggtttgtggcctccaactccaaggatgaccctgccaaggaggctgccagcttcacctcccaggtcatcatcatgaaccaccctgggcagattggcaacggctatgccccagtgctggactgccacacctcccacattgctgtcaagtttgctgagctcattaccaagatcgacaggcggtctggcaaggagcttgagaaggagccaaagttcctgaagaacggtgatgctggtatggtgaagatgataccgaccaagcccatggtggtggagacgttctcagcgtatcctccccttggtaggtttgctgtccgtgacatgaggcagacggttgctgttggagttatcaagagtgtggagaagaaggacccgaccggcgccaaggtgaccaaggcggctgccaagaagaaatga

SEQ ID NO: 276 - DNA, 1338 bp, Zea mays
atggatgaggagtacgacgtgatcgtactaggcacggggctcaaggagtgcatcctcagcggtctcctctctgtagacggcctcaaggttttgcatatggacagaaatgactactatggaggagattccacctcactcaaccttaatcagctctggaagaggtttagaggggaagacaagcccccagcacatctaggtgcaagcagagactacaatgtggacatggtgccaaagtttatgatggcaaatgggacattggttcgaaccctcattcacaccgacgtgacaaagtacttgtcattcaaagctgttgatgggagctatgttttcagcaaagggaagatttacaaggtccctgccactgatatggaggctctgaagtcccctttgatgggcctattcgagaagcgcagagcaaggaacttcttcatttatgtccaagattacaatgaagctgatccaaggacacatcaaggattggaccttactagggtgacaactagagaacttatagcaaaatatggtttaagtgatgatacagtggatttcgttggacatgcacttgctcttcatagagatgatcgttatctcgatgaaccggcacttgatacagtgaaaaggatgaaactatatgcagactctcttgcacgctttcaaggaggctcaccttatatctatccactatatgggttgggtgagctaccacagggttttgcacgactgagtgctgtttatggtggtacttacatgttaaacaagccagattgcaaggttgaattcgatatggaggggaaagtgtgtggtgtcacatctgaaggtgaaactgcaaagtgcaagaaggtggtgtgtgatccttcgtatttacaaaacaaggtcaggaagattggtagagttgttcgtgcaattgctatcatgagccacccaatccctaatacaaacgagtcacactcggttcaaattattttgcctcagaagcaacttggacgcagatcagacatgtatgttttctgttgctcatacacgcacaatgttgcaccaagagggaagttcattgcatttgtgtctgcagaagcagagactgataatccccagtctgagctaaagcctggaattgatctacttggttctgtagatgagattttctatgatatctatgacagatatgaaccagtgaatgaaccatctcttgataattgctttgtctcgacaagctatgatgccaccacacattttgagacaactgtaacagatgttctgaacatgtatacaatgatcaccggaaagactgtagaccttagtgtggatttgagtgctgctagtgctgccgaagaatactga

SEQ ID NO: 277 - DNA, 1452 bp, Zea mays
atgagttgtagggagggacttatgtcaccacaaacagaaactaaagcaagtgttggatttaaagctggtgttaaggattataaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaagagggttctgttactaacatgtttacttccattgtgggtaacgtatttggtttcaaagccttacgcgctctacgtttggaggatctacgaattccccctgcttattcaaaaactttccaaggtccgcctcacggtatccaagttgaaagggataagttgaacaagtacggtcgtcctttattgggatgtactattaaaccaaaattgggattatccgcaaaaaattacggtagagcgtgttatgagtgtctacgcggtggacttgattttaccaaagatgatgaaaacgtaaactcacaaccatttatgcgctggagagaccgttttgtcttttgtgccgaagcaatttataaagcacaagccgaaactggtgaaatcaaggggcattacttgaatgcgactgcaggtacatgcgaagaaatgattaagagagctgtatttgcaagggaattaggggttcctattgtaatgcatgactacttaacaggaggattcaccgcaaatactactttgtctcattattgccgcgacaacggcctacttcttcacattcaccgagcaatgcatgcagttattgatagacagaaaaatcatggtatgcatttccgtgtattagctaaagcattgcgtatgtcggggggagatcatatccactccggtacagtagtaggtaagttagaaggggaacgcgaaataactttaggttttgttgatttattgcgcgatgattttattgaaaaagatcgttctcgcggtatctttttcactcaggactgggtatccatgccaggtgttataccggtggcttctgggggtattcatgtttggcatatgccagctctgaccgaaatctttggagatgattccgtattacaatttggtggaggaactttaggacatccttggggaaatgcacctggtgcagcagctaatcgtgtggctttagaagcctgtgtacaagctcgtaacgaagggcgcgatcttgctcgtgaaggtaatgaaattatcaaagcagcttgcaaatggagtgctgaactagccgcagcttgtgaaatatggaaggagatcaaatttgatggtttcaaagcgatggataccatataa

SEQ ID NO: 278 - DNA, 1506 bp, Zea mays
atggacaccgtcggcgtccccgtggtggccgttgcgaatgggatcggggaggtggagcgcaaggtgcagaagagctactgggaggagcactccaagtgcctcactgtcgagtccatgatgctcgactcccgcgccgccgacctcgacaaggaagagcgacccgagatcctgtctttgcttccctcttacaaagggaaatcagttctagaactcggtgctggaattggacgctttactggagatctggcaaaagaagctgggcacgttctggcactagactttattgaaagtgtgattaagaagaaccaaagcataaatgggcatcacaagaacataaccttcaggtgtgccgatgtgacatctaacgacttgaagattgaagataactctgttgatctgatattttcaaactggctattaatgtatctttcagatgaggaggtccaaaagcttgtggggaaaatggtaaaatggttaaaggtcggaggccatattttctttagagaatcatgttttcaccaatctggagattccaaaaggaaggtgaacccaacacactatcgagaaccaaggttttataccaaggtatttaaagagggccattcatttgatcaagatggaggttcgtttgaactttctctagtgacctgtaaatgcattggggcttatgtcaaaaacaagaagaatcaaaaccagatatgctggttatgggaaaaggtaaaatcaacagaagacagagattttcaaagattcctggacaacgtgcaatacaaaacaagtgggatattacgttatgagcgtgtctttggtgaaggttttgtgagcactggtggaatcgagactacaaaggaatttgtgggcatgctcgatcttaaaccgggccagaaagtacttgatgtcggatgtggaattggaggcggcgacttttacatggctgcaaactatgatgtccatgttcttggtattgatctttcggtgaacatggtttcatttgcaattgaacgtgccattggacgcaagtgctctgttgaattcgaagttgctgattgcaccacaaaggattacccagaaaatagttttgacgtcatctacagccgtgacaccatccttcacatacaagacaagcctgctctgttcagaagcttcttcaaatggctaaagcccggcggcaaagtcctaatcagcgactactgtaagaatcctggaaaaccatcagaagaatttgctgcgtacattaagcagagaggctatgaccttcacgacgtgaaggcttatggacagatgctgaaggatgctggttttcataatgtcatcgcggaagatcgcactgagcagttcttgaatgttctacagagggagataggtgaagttgaaaagaacaaagacgctttcctggcagacttcacccaggaggactatgacgacattgtgaatggctggaacgcgaagctgaaacggagctctgccggcgagcagaggtgggggttgttcattgccaccaagtga

SEQ ID NO: 279 - DNA, 6111 bp, Zea mays
atggctcagaactcgtcccgtcttcaccgcctcctcacattactagacactggttcgacacaagcaacgaggtttgcggctgcacgccaaattggagaaatcgccaagtcccacccccaggagctgaattcgttgctaaaaaaggtttctcaatatattcgtagtaaaaattgggacacgagggttgcggcagcccatgcgattggtgccatagcagagaatgtcaaacacacatcattgaaggacttgtatgcttccgtgcaagcagaaaaacatgcttccggtttctctgatggaagtgatgatgctggctcagcattgccacggactgatagtgcagcaacatctgatcttgcttttggaagctttgacataggcagggtattggaatttggatctcctctattggcatcaggtggacaggaatacgacattgctgatagtggcaagaatccagcagagcgtctagctcgccaaaagaaaaatctccggcgtcgtttaggactggatttatgtgagcagtttatggatgttaatgacgttatcaaagacgaggatcttcttgcccaaaaaaattattggggttcacatgtacagaataatggattccattcatttaattcaggtcataatattcagcagttggtttctaccatggtccccaggtatcccaagcattctaattttcgctctagacgattaagtgccagggagttaaatatgctgaagcgtaaagcaaagagtaatgcaaaagatcatacaaaggctgtatctgaggatgatgaggttacactgaaaggatctgtgccctccaatggagcttcttctgaacaagctggtgcacaaaatggtgtatttgatacagctgtcgaagaagacaatctggagtacaatgagaacggaagatggccttttcaacaatttgtggatcagcttattcatgatatgtttgatcctatttgggaagttcgccatggcaccattatggctttaagggaaattttgacacatcatggtgcttgtgctggagtatattttcctgatctgagcttgccttcctctgacttggatggtaaaaccaactttgactcccttaaaagggaacatggtatcgatctaaacgaagatgtccatttggaacaccttgaaccagcattaaagaagcataagaaagagccaaaatgtgctgaaagtatgatggattgtgataaggagttggttgacagtgattatctaaaaacggaaggagatctgagcaatgtgcctgatgtattaactgccgaaccaaattctactcatgtaaaagttgagcctgagttctgtgttgatgattcagctgacccctctaaaggcgtttcgacatgtaaatcacagaaaaaactcaactccatatcacatctgagttctcatattcttgctccagaaagttcaaaattcatgaaactgatgaaactagccaaatactcatatatgaagaattgggaatttcttcaggattgtgcaatccgcttcctttgtgtgctttcactggaccgctttggtgattatgtatccgatcaagttgtcgccccagttcgtgaaacttgtgctcaagctcttggtgctgtgctgaagtacatgcacccttctttagtatgtcatacattcaaaatcttgctgcagatgcagcacagacaagagtgggaagttcgtcatgggagccttcttggcattaaatacttagttgctgttcgccaggaaatgcttaaagatttgcttgactatatcattcatgcttgtaaagctggtctggaggaccctgatgatgatgtccgagcagtggctgcagaagccctgattccagctgccgactctttagttaggctaaatgaccaaattttgcatccaattgtggtgttgctttgggatatactgcttgaccttgacgatttaagcccatctacaagcagtgtaatgaacttgttagcagaaatatattctcaaccagagatggtcccaaagatgcttggcacagcagcttcaggggaaaagggagaatttgatctaaacgaagcaactcagattgctgagcaagaagacgaactaacatctattgaaaacccttacggtctagctacactgacaccccggctgtggccctttatgagacatagtattacttctgttcggcgttccgccatacgaacactggagaagcttcttgaggttggcaacactaggagttctgctggaacaaccccatctaaactctggccaacatcaatattaggtgatgcactgcaggttgtatttcagaacctacttttggagtcaaatgatgatattcttcagtcttctgaaagggcttggaaacttctacttcagtgccctgagaaggaccttgaatatgctgcaaggttatattttagtaattgggtacaacttgctaccactccatttggctcagcattggattctacaaaaatgtttttaccagttgcccttccacgaggaaatcgttcgagagctgctgcaaagattagatctgctaggctagaacatgagtacacaacaatgatctcgtttggttctacaggggaaagtatttcacatgaaaagcattcggacgttccctctattttttcgaatataattgttggctctgatcctgacaaatctgttactcatacacgggttcttacgtcaatggcccttgggctttttgcctctaagttgcccgtaagctcatggcaagtggttttaagtccactagcaaatcacctcatgtctctctcaggagtccagagacaagtggcttcaatgatcatcgtttcttggttcaaagatctgagaggcagagatcctgtatcagtgggtacattgctagcttttctatcttccttgaaagagtggctggtggacttattgacttgctctgatccagcattacccacaaaaggttctgtgcttccatattctgaactttcaaggacatacacgaagatgcgcaatgaagccaataatttgctccacttaatcgattcatgtgctgctttcaaagattatagtagcagcttaaaccttaacactgacgtgctgactgttgatgatgctatcaactttgcatcaaagcttttgttaccatctgaatctgatattccttcagaaactgagaacattttcttgaataacatagaatcagcaaaacaaggcctattgtctacatcaggttacttgaaatgtgttcagaataatttgcatgtgacagtctgttctttggtggcttctgctgtagtttggatgtcatgtttgcccagcaagttgaaccctgttattttacctttaatggctgccattaaaagagaacaggaggaagtacttcaagataaagctgctgatgcacttgctgagcttatatttagctgcattggccgcaagcctggccccaatgacaagctaaccaagaatctctgcactctaacatgcactgatgctagtgagacacctcaagctgcaataatcaactcaatgcaggttattgaggaccagaatttgctatcgattggaaagcgttttagcagtcatagatccaggggccatacaacgtctggtggcgatgaaaggtcaaaaatggagggttttataagccggcgtggatcagagttggctttcaagcatctctgtgtgaaatttggaccttcattgtttgaaaaccttcccaagttatgggattgccttactgagtttcttagacctgtaaaaacagaagatggtattccggaagatgatgcaagtattgcacagctgggcagatcgtatgaggataaggacccacagtcactcattaataatatccaggtcgttcgttccatttcacctcacttggctgagcccttaaggcctcaactgctaaatctccttccctctattcttgggtgtgttcgtcatcctcatgtggctgttagactagctgctgcaagatgcatcacatctatggcaaagtcattgaccgatgatgtgatggtactggtgatagaaaatgtcatcccaatgttgtccgatttatcttctgtctgtgcaagacaaggagctgggattctgttaagccttcttgttcagggtttggctgtggagttggttccttatgctcctttccttgtcgttcctcttctgaagtgtatgagtgacccagatggttctgttaggcagactgtgactcacagttttgctgctcttgttcctttgctgccattatcaaggggtgcttctttaccatgtggactaagtgaacgcttatctagcagtgctgaagatgtgcaatttctggaacagctccttgacaatacccaaattgatgatttcaagcttaatattgatcttaatgttgaactacgaaggtatcagcaagaagggatcaactggcttgcattcctccgtcggtttaagttacatggaattttatgtgatgacatggggctcggtaagacgctccaagcatctgctattgtagcaagtgacattgcagaagcacgtgcacggaatgatgaaaaaattctgacatctttgattatctgcccttctacattagtggcccactgggaatatgaaatagagaagtacatagacagctctatcttgaaacctcttcagtacgttggttcttctcaggacagagtgacactccgtagtcagtttgataaggttaatgttatcataacatcatatgatattatacggaaggatattgattttcttggaaatatcacttggaactattgtgttctggatgaagggcatataataaaaaactcaaggtctaaaataacgtttgctgtgaaacagctgaaagcgcaacaccgtcttatcttgagtggcacacctattcagaataatgtgttggagttatggtctttatttgacttccttatgcctgggtttcttggaacagaaaaacaattccaagctgcatatggaaaacccttgctagctgccaaagattctaaatgttcagcaaaggatgctgaagctggtattcttgcaatggaggcactgcataagcaggtcatgccgtttctactgagaagaacaaaggatgaagttttatctgatcttccagagaagataatccaggatagatattgtgatctcagtctattgcagctcaaactttatgacaaattttccagctccaatgcaaaagacgagatttcaactatagtaaaagcaaatgaactggaggaatctgcacctcaaccaaaggcaactcggcatgtgtttcaggcattgcagtacctattaaaactatgcagccatcccttgcttgtaactggggagaaccccccaaatcatcttgtggatcttctgaatgaaataggtctgggatctggcagtgagcttcatgagcttcaccactcacctaagcttgttgctcttcaagaaatacttcaagaatgtggtatagggtcagaaatatctagtcctgatgcttctacagctgttgggcaacacagagttttgatttttgctcagcataaggcttttcttgacatcatagagaaggacctgtttcaatctcatatgagaagtgtcacatatttgcggctggatggctctgttgatccagagaagagatttgaaatcgttaaagcattcaattcagacccaaccattgatgtacttctgctaacaacccatgtcggtgggcttggcttgaacttgacatctgccgacacattggtgttcgtggaacatgattggaacccaatgaaggaccttcaggctatggacagagcacatcgattgggtcaaaggaaagtggtgaatgttcaccgtctcatcatgcgtggcacccttgaggagaaggtgatgtctctccagaggttcaaggtgtcagtcgccaatgctgtcatcaatgctgagaactcgagcttgaagaccatgaacactgaccagctgcttgatctgttcacatcaacccctgcttcaagaaaagcaagcgacgagcagagtaagaggaaatctggtggcaaaggcttgaagtccattcttaatggtctggatgagctttgggatcagtcgcagtatgccgatgagtatgatctgaaccagttcctggcgaagctgaacggctga

SEQ ID NO: 280 - DNA, 234 bp, Zea mays
atgggcggcggcaacgcccagaagtccaagatggcgcgcgagaggaacgccgagaagaacaagggcggcaaaggcagccagctggaggccaacaagaaggccatgaacatccagtgcaagatctgcatgcagaccttcatctgcaccacctccgaggccaagtgcaaagaacatgcggaggcgaggcatcccaagaacgacctctaccagtgcttcccccacctcaagaactag

SEQ ID NO: 281 - DNA, 981 bp, Zea mays
atgaggccgatcttgatgaagggccacgagcgcccgctcacgttcctgcgctacaaccgcgacggggacctcctcttctcctgcgccaaggaccacacccccacggtctggtacgccgacaacggcgaccgcctcggcacctaccgcggccacaacggcgctgtctggacctgcgacgtctcccgcgactcggcgcgcctcatcaccggatccgccgaccagaccgccaagctctgggatgtcagcacggggaaggagctcttcagcttccgcttcgacgcgcccgccaggtccgtcgagttcgccatcggggacgcgctcgccgtcgtcaccaccgacaacttcatggaccacgtccccaccgtccaggtcaagcgcatcgccgaggacatcgacgaccagacggaggagtctgcactcgtcatcaccggcatcaagggaaggatcaacagggccgtttgggggccgctcaacaggaccatcatcactgccggagaggatgccaccgttcgcatttgggattcagagactggacaacttctgaaagagtctgacaaggaatccggacatcagaagaccatttcatcattgtcaaaatccctagattggtcacattttattactggctccttggataaatctgccaagctatgggatacaagaacgctgaccctgatcaagacatatgtcacagagagacctgttaatgctgttgacatctctcccactcatgatactgtggttctaggaggtggtcaggatgcaatgaatgtgactatgactgaccgccgtgctggtaaatttgaggctaaattctaccacaagattttgcaagaggaaattggtggtgttaaagggcattttgggccaattaatgctttggcatttaatcctgatgggcggagcttttcaagtggtggtgaagatggatatgtaaggttgcatcattttgattctgactactttagcatcaaaatgtag

SEQ ID NO: 282 - DNA, 3285 bp, Zea mays
atggaggctagcgcggggctggtggccggctcgcataaccggaacgagctggtggtgatccgccgcgaccgcgagtcgggagccgcgggcggcggcgcggcgcgccgggcggaggcgccgtgccagatatgcggcgacgaggtcggggtgggcttcgacggggagcccttcgtggcgtgcaacgagtgcgccttccccgtctgccgcgcctgctacgagtacgagcgccgcgagggctcgcaggcgtgcccgcagtgcaggacccgctacaagcgcctcaagggctgcccgcgggtggccggcgacgaggaggaggacggcgtcgacgacctggagggcgagttcggcctgcaggacggcgccgcccacgaggacgacccgcagtacgtcgccgagtccatgctcagggcgcagatgagctacggccgcggcggcgacgcgcaccccggcttcagccccgtccccaacgtgccgctcctcaccaacggccagatggttgatgacatcccgccggagcagcacgcgctcgtgccgtcctacatgagcggcggcggcggcgggggcaagaggatccacccgctccctttcgcagatcccaaccttccagtgcaaccgagatccatggacccgtccaaggatctggccgcctacggatatggcagcgtggcctggaaggagagaatggagggctggaagcagaagcaggagcgcctgcagcatgtcaggagcgagggtggcggtgattgggatggcgacgatgcagatctgccactaatggatgaagctaggcagccattgtccagaaaagtccctatatcatcaagccgaattaatccctacaggatgattatcgttatccggttggtggttttgggtttcttcttccactaccgagtgatgcatccggcgaaagatgcatttgcattgtggctcatatctgtaatctgtgaaatctggtttgcgatgtcctggattcttgatcagttcccaaagtggcttccaatcgagagagagacttacctggaccgtttgtcactaaggtttgacaaggaaggtcaaccctctcagcttgctccaatcgacttctttgtcagtacggttgatcccacaaaggaacctcccttggtcacagcgaacactgtcctttccatcctttctgtggattatccggttgagaaggtctcctgctatgtttctgatgatggtgctgcaatgcttacgtttgaagcattgtctgaaacatctgaatttgcaaagaaatgggttcctttcagcaaaaagtttaatatcgagcctcgtgctcctgagtggtacttccaacagaagatagactacctgaaagacaaggttgctgcttcatttgttagggagaggagggcgatgaagagagaatacgaggaattcaaggtaaggatcaatgccttggttgcaaaagcccaaaaggttcctgaggaaggatggacaatgcaagatggaagcccctggcctggaaacaacgtacgcgatcatcctggaatgattcaggtattccttggccaaagtggcggtcgtgatgtggaaggaaatgagttgcctcgcctggtttatgtctcgagagaaaagaggccaggttataaccatcacaagaaggctggtgccatgaatgcactggtccgtgtctctgctgtcttatcaaatgctgcatacctattgaacttggactgtgatcactacatcaacaatagcaaggccataaaagaggctatgtgtttcatgatggatcctttggtggggaagaaagtgtgctatgtacagttccctcagaggtttgatggtattgacaaaaatgatcgatacgctaacaggaacgttgtcttttttgacatcaacatgaaaggtttggacggtattcaaggacccatttatgtgggtactggatgtgttttcagacggcaggcactgtatggttatgatgctcctaaaacgaagaagccaccatcaagaacttgcaactgctggcccaagtggtgcctctcttgctgctgcagcaggaacaagaataaaaagaagactacaaaaccaaagacggagaagaagaaaagattatttttcaagaaagcagaaaacccatctcctgcatatgctttgggtgaaattgatgaaggtgctccaggtgctgatatcgagaaggccggaatcgtaaatcaacagaaactagagaagaaatttgggcagtcttctgtttttgtcgcatcaacacttcttgagaacggagggaccctgaagagcgcaagtccagcttctcttctgaaggaagctatacatgttatcagctgcggctacgaagacaagaccgactggggaaaagagattggctggatttacggatcgatcacagaggatatcttgactggatttaagatgcactgccatggctggcggtctatttactgcatcccgaagcggcctgcattcaaaggttctgcgcctctgaacctttccgaccgtcttcaccaggtccttcgctgggcccttgggtccgtcgaaattttcttcagcaagcactgcccactttggtacggatacggcggcgggctaaaattcctggaaaggttttcttatatcaactccatcgtttatccctggacgtccattcctctcctggcttactgtaccttgcctgccatctgcctgctcacggggaagtttatcacaccagagcttaccaatgtcgccagtatctggttcatggcacttttcatctgcatctccgtgaccggcatcctggaaatgaggtggagtggcgtggccatcgacgactggtggaggaacgagcagttctgggtcatcggaggcgtttcggcgcatctgttcgcggtgttccagggcctgctgaaggtgttcgccggcatcgacacgagcttcaccgtgacgtcgaaggccggggacgacgaggagttctcggagctgtacacgttcaagtggaccaccctgctgatacccccgaccacgctcctcctgctgaacttcatcggggtggtggccgggatctcgaacgcgatcaacaacgggtacgagtcgtggggccccctgttcgggaagctcttcttcgccttctgggtgatcgtccacctgtacccgttcctcaagggtctggtggggaggcagaacaggacgccgacgatcgtcatcgtctggtccatcctgctggcctcgatcttctcgctcctgtgggtccgcgtcgacccgttcctcgccaagagcaacggcccgctcctggaggagtgtggcctggactgcaactga

SEQ ID NO: 283 - DNA, 801 bp, Zea mays
atggcagtggttggcctatccagtgctttcgctcctctcagaggttcttggatagccgtaaggatcaggcagggtggccaacgtgcagggatcagcttgtgtccatctccaaggagcaggaggagctgcgcggcagtggttcgggcggaggtgagcttcgtggacgccgacgaggcgaagaggctcgtgggcgaggagggctacacggtgctggacatcagggacagggcgcagcgcgagagggcacacatcaagtcctccacacacgtgcctctcttcattgagaaccaagacaacgacattgggaccatcgtgaagcgccagctgcacaacaacttcgcggggctcttcttcgggctgcccttcaccaagctcaacccggacttcgccctgacagtcaaggacaagttctcgccggaaagcaagctgctggttgtctgccaggaaggtctcaggtcagcagctgctgcagatgcactggagaaagaaggcttccaaaatattgcatgcatcacatcaggtcttcaaacagtgaagccaggaacgtttgaatctgtggggaaaagtgagctgcagaacgcggggaaagctggccttgtgaccatccaagggaagatttctgtagtccttgggactgtattgattagtaagattattggattaccctctttcagagataatcaaatgtaccagctcatcaccctatcttatgggcgctcatgtgcaggtgcctacctgtttataacattcttcccagaccaggctgagaagctttttgacttggctggcatcagcttgtga

SEQ ID NO: 284 - DNA, 915 bp, Zea mays
atggccgcggcgccgtcgtccctcgtgtcctcccatctctcccgcctcgccgacctccgccgcgcggcggcgccggccactcccaccgtcccacagcagcttcgcgtcggcttctcgcgccgccgcgcccagcgcgtcgtcgccatggctggatccggcaagttcttcgtcggaggcaactggaagtgcaacggaacaaaggactccgttagcaagcttgtctctgaactgaatgctgctaccctcgaaactgatgtagatgttgtggtggctcctccattcatctatatcgatcaggtcaagaattcactaacgggtcgcattgaggtttctgctcagaatgtgtggattggaaaaggaggagcctacaccggagagatcagtgcagaacaactggtggacatcggttgtcaatgggttattcttggacactcagagcgtagacatattattggtgaaaatgacgagtttattgggaagaaggctgcatatgcattgagccaaaatgttaaggttattgcctgcataggagagcttctggaagagagggaagcagggaaaacttttgaagtatgttttgagcagatgaaggcttttgcagatagtatttcaaactgggccgatgttgtgattgcatatgagcctgtttgggctattggaaccggaaaagttgctactcctgagcaagcccaggaagttcatgctgctgtacgcgattggttgacgaccaacatatcacctgatgttgcctctagcacccgaataatctatggaggttctgtgaatgcagccaactgtgcagagctagcaaagaaagaggatatcgatggttttcttgttggtggtgcctccttgaaggccccggacttcgccaccattatcaactcagtgaccgccaagaaagttgcagcctga

SEQ ID NO: 285 - DNA, 4062 bp, Zea mays
atggaggccgatgcgccgctcgacctcgcgctcttccagctatcccctcggcgtcagcggtgcgagctagtggtgtgcggcaatgggcggacggagaagatcgcgtcagggtcggtgaagccgttcgtggcgcacctgcgggctgcggaggaacaggcgtcggctcagccaccgccgctggccatccggctgcagctggagcggcccgccccgtggtttagcaagggcacccttgagaggttcgtgcgcttcgtgagcacaccggaggtgctggagttggcgaacacctatgatctggagatgtcgcagctggaaggggccaggaagatttatgcgcagggaggtactggagatgctacttcaggtggagctgctgaaaatgttacagcctcagcggcagcggcggcagatattacaaagaaagaacttcttagggcaattgatgtgcgtctaagttcccttaaacaagatctggccgcagcttgttctcgagcatcctctgctgggttcaatcctatcagtgtatctgagcttattctttttgctaaccattttggtgccagtcggctgagcgaagcatgcacaaagttcatgtcactttgccagcggcgtcctgacatcagtcctcaaactgcacagccagcagtttcatcacactggaaggtctttgacgatgggaatgtccgtggttcttcgagttcagacatgtctatagatgaaccactagttgatctcagtgaatccaagaacaaatctacagtcagtggaagtggctctcaggtccacagactaagcaacatccaaggtttagaatctgctgcagcacagcaacccaagccaaccatccaacaagcagtagataaacaagaagcagaaacagatgcgtctcctgcaccttctaaaggagagctttcaaggcggctgagtgtgaaggacaggataaacatgtttgagagccagaaaaaggagcagactccaagttctggtaacagcaactctgccggtactggtagagtggttccagggaaaggtgagcaccgcagggttccttctggcgcctccatggagaagttagttagaaggtggagcagtgttagcgacatgagtattgacctcagcaacaatgagagtagtagcttaaatgacaaaaaggataatggaactcctgccgggactccaacatctactgatttggaggccgactctaaagtaagagctaatgaggactctaatggacagaaggattcaatcacgtcacactcttggccttgtcaaaaggataatgtaccaatggatctggccaccacagatttgtgcccaccctcaattttaagtaatacacttgctcctcataaagagagtatatatggtgatggtgcagaaaacgacatggttatgaactctagcattgaaagtgaagcatcctttgggaaagaaccgggggttattcaaggacacacaaggatgtcaaatcatgctacttcaaatgtttccactcaagaccgtctaaaatcttctgcaaagtcagttgaagaagccttgctgaaaaataaagttattgtaactagtgcatcgtcagaggagcatgtctgcatgatagacaaggaaatcacagctgttgctcatgaagtaccagttgcaagtgaacagattccccagaatgatattagaggtctccatacaaaagatattcacactgaagcagaagtgactggaaggaaggatcagccttcacgatcatttggaagggtatctggtggtgttaatcctaaaccaaaagcctcatccaattcccgagctaatgctaaaggctcatctgttagggatgcgattgcctctacagaaactgagttccgtgacgttagtttgcagcggaatcgtctaccacggaagtcagaagatgtagggaaaaaggttacagctggttctgattcagattgctctggtcgtcagggaaaaaatttgagcaggcaatcatccattaccgatcaggaactaaacttgcaggctagagtgacaagaccaggaaaagggaaccaagatcggcatggtgaattgcaaatgaaggccaatgagttggagaaattatttgctgaacacaagttaacatcctcccgacgaggtaaacctacagatgtgcaggttgaaagcacacctatggtgagtgaggtaaagccgacaatggttcttcatgagacaattcatacaaaacaagttgtaaaggagagtataactgtcaatgattttgatgccggtgagcttctgaagatggtgaataatcaagaatttaacattagcacaccacaaaaacttggcattctaagtttagaagagtcgagagggaagttttatgagcattatatgcagaagagggatgcaaaactgaaggaaggctggaagctgcagagagaggagaaggaagcaatgttaaaggctatgcatgacagcctagaacggagcaaggctgagttgcttacaaaattctctcggtctgcagatgtccctgactcaacttatgtttcccattgttctcagaagattcctccttcgcgatcagcaagaaaaaataaagatcagggggttggctcattcttggtggaagaggaaatgaatagtgactacctatctggtgatggttcttccaggagtgctgattccagaaagcatttttcaaataaagttgcttctacccaaaatgcatctgctggtcctatccataaacgttcatcaagaaccgcaagctctggttatgctaatcgcaggaatccaccagaaaatcctctcgcacagtctgtccccagtttttctgacttgagaaaagaaaatacaaagccttcacctggagtcagtagagtgagtgcaagagttcagcaaaagtcttttgcccgtagcaagagtattattgaagagtcaaagagcatattgaaagaagatcaatcgaggaggtcacaatctatgaggaagaaccaaattcctgatgagcttaaggacatttcgtcagggaatgatgatatttacaattgggctccctcaagaatttccaagaatcaatcagagggaccttttgcttacagtacccgtagatcgggtccaccaaagccttttcttaggaaaggcaatgggactcaccctgttattggtatagctggatttcaggctgcagctgccatgatggcgaatgccctccagcatggtgacagtggtgattttgaagatcagcaagaggattcccctgatgatgccaaagaagaggaagaatatgaaagcatggaagaaaatcttagagaaagtgactttcctgctgattctgacagtgagaacccaagagtgagtcatgaatttggaaattcagatgacccagggtcagaaaacggtgatgctgattttccaagcaaaacacctgccattggcagtactaagttcactgcttttacaggaaatgttcacaatccagctggtgatgttccagcaccctggagttctcgtcttccacagctgttcccttacacgaatgataattcagatggtgacgcctttgctgattcaccatcgggaagtccatcaccatggaattctcattcactggatgaaataacagatgctgatgtatctcggatgcggaaaaagtggggcagtgcacagatgccttttgctggtgtcaatgcacctcaacagccacgcaaagatgtttccaaaggattgaagaaattgtggaaatttggtaggaagactagaggcggtgacggtttagtaaatgattgggtatctgcctccactgcctcagaatgtgatgatgacatggaagatggacgggatctggtagtaggatcttctgatgatttcagaaagtctcgaatgggttatcttgcttcatatgacggttttgttgagaacgaggttttttctgaacaagaacaatcactacgcagctccattccaaacccacctgcaaatttcagattgagggaggatcagctgactggaagttctcttaaagcgccgcgttctttcttctccctgtcaacattccgaagcaagggaggtgatgccaggctcaggtga

SEQ ID NO: 286 - DNA, 2652 bp, Zea mays
atgggcccatcaaagggttctcgaactattaacaagatcatagtaaaaggatctgaatatcaacagcagcatgatgatccatctagttcaagcaaagctaaacagaaaaggaggaaactctcagactttgatcccaaatggagcaaggatgaacttacaaatttttatgaagcctaccgtcaatatgggatggactggagaaagatcagcatagcgataggcactaagtcatcggacatggtgcagtctcttttcactttacatcggactttcttatctcttccagaacatcaagccactgccatgggatttattgcgctggtgactggtcatcacaatgcttcggagaaaaccacgactcatagaggatatgatcacgtagtcagagcatctggaaaggcaaggaaacatggtgaaaaaccgaaatcaattgatggacctgacctgcccaactgtcaagaagcgaaaatttctggattttcagatttattccagagtcgatactatggcgtttcttcagaattggtcaggtacatccgaaatcatgctgttcggaggcgtactcctcgtataccagctatagtttctgcagacaggagtaccattgatgaggccacaccaggaattgaaaatgtcatcagttctaccaagagaaaatatgaagcagccaataacgactctgctattgtcccaacaaataagtactctcctgacagagtttctggcttcgctgaagcacacaaggctggtcaagatcattgtttgttggagaccataggaactgggcatgtagcgacatgtcaacaacattcaaagaaaacaagaattcagcaaactatggaggaaggtcagactggtgtagttgatcatgagacaacgatggcatctaaagaagggaataagccagttgatttattaaacaacaatcagttatttatcgacaatatttctgaagatgatatgttggtcttggatgtattgtgtagcctgatgaatgcaccctctaaaatgccaaaactagagattaatattccttcaggttcggttggaaaaactgactctacgctatctcagagaagggaggaaggccaccctaccattgatttatctaaacaagggaagccagttggtaaatccagtgcttccaagactaggaagaaaaaatataagatattagacgcagaggtgcctgctgtagcacaaaacgtttgtggtaatagtttagccctgccggaaacactgagggttgttatcactgatgattcttccttgtgtactgactctggaagagtggggataccggaagcatctgaagatattcctgctgaagttcccagtgcacaaacagaaaccaagcctgaagtgagaatgtctggaaggaccagacggaaatctcaaatgcattgcaaaacaaagcatatgtcatgcaatgaaggttcagataatttacaggcaaaaaaattgctgcactgtttgtcatccgaaccacttcgtagatggtgcacatatgagtggttctacagcgcagttgattatccatggttttcaagtaatgagtttgtgcactacttagatcatgcaaaattgagtcatctttcaaggttgactataccagaatggggtacaattcgaagctcccttggtattccacgtcgattttcaaattattttctggccgtggaaaaagaaaatcttgaggattatcgggagaaagttagaaaaatctatgctcaactcagtgatggttcaagggattttctacctgcagacctagctagaccattttcaattggtcagcaagttattgttcgtcatccaaattctagggaactttgtgatggcaaagtggtgatgatgggtccggattgttacaaggttcattttgatgatcctgacattggtgttgatattgtaaaggacactgattgtatgccagtcaactggctgtataaccgtcctgacaacatgaggagctgcctttcaaatgatgcgtacagcatactggagatggatcacattcctgaccttacagcaagtgagaatgaggatcatgctgtaaacggatctactgtacttgaggggctcaaaagtctgcgcttaacatcagatagacaacctaaggcagaatctattgtaaacagtgaaagaccaccatataggagtacatctgacagccctgcaaaatctagagattgcccagacaataatagtgctggccactacgatgagctagagtcatatatagccgcatttgcagaaagatcactatcacaagccaggcagatggttgacaaagccatgcaggcgaaccctggaggtaatgaggatgaaaaggtatgcacgtcaaatcaagtggcaggttgtgcaggcccaggttttgaacctgcccgtggcgcccaacttccttctgacctgatatcgaacggcatcgccacggttctttcaatcaagagccttagcgactcgcgacatccgtttgctaacgtagcaggcgtcttggatcacgcttgctccatgctgcgtccaagctgtccgcagaacctcgctttgtacgatcaaataaagagagacatcggtatcataaagacccagatatttgcacttatgccaacagcattgggcaattgcagccctcctgtcccgcccatgtaa

SEQ ID NO: 287 - DNA, 729 bp, Zea mays
atggagtacgtgaaccccctcaccggcttccgcgtcgacggccgccgccccaacgagatgcggcaactcaagggcgaggtcggcgtcgttgcgcgcgcagacgggtcggcgctgttcgagatgggcaacaccagagtcatcgccgccgtctacggcccgcgagaggttcagaacaaaggtcagcaagtaaacagcaaggaggctttggttcgttgtgagtacaggatggcagagtttagtacaggagatcggaggagaaaaccgaagggtgacaggcgatcaacagaaatttctcttgttattcgacagacaatggaggcaagcatattaacacatttaatgccacactcacagattgatatatatgtccaagttcttcaagctgatggtggaacaaggtcagcttgcataaatgctgcaacactagctcttgcagatgctgggattccaatgcgagacattgccacatcatgtagtgctggttatctgtgttctactcctttgctcgatctgaattacctcgaagacagtgctgggggttctgatgtcactgttggcattcttgcaaagatggacaaagtgactttgcttcagatggatgcaaaattaccaattgatacatttgaaaatgtaatgggacttgcaatagaagggtgcaaagcaattgcaacttacatccgagaggtgctattggagaatacaaagaagcttgagtgtcagcgtggttaa

SEQ ID NO: 288 - DNA, 450 bp, Zea mays
atggcggaccagctcacggacgagcagatcgcggagttcaaggaggccttcagcctcttcgataaggatggcgacggctgcatcactaccaaggagcttggaactgtgatgcgctcccttggccagaaccccactgaagcagagctgcaggacatgatcaacgaggttgatgctgatggcaatgggaccattgacttcccagagttcctgaacctgatggcaaggaagatgaaggacaccgactccgaggaggagcttaaggaggcctttcgcgtcttcgacaaggaccagaatggtttcatctcggctgctgagctccgccatgtcatgaccaacctcggcgagaagctgactgacgaggaggtcgacgagatgatccgtgaggccgatgttgacggcgacggccagatcaactacgaggagttcgtcaaggtcatgatggccaagtga

SEQ ID NO: 289 - DNA, 1173 bp, Zea mays
atggccctcatccaaagcctcctgaaccataccacattagaaactgataccgtcctattcaaacttgttaccgctgttccagagcaacaaaagcagcctgtgcaatcttatgatacagatatattttctaggcatgatcaaaagctcttaaaggcttcagcatttttacctactatagaatccccatttgttccaaattcgtttaccgggaagagaaaatcaactgttggtaattctcccgtagtccaacctcatgttggatcacgggctgtccatgagtaccagttccttcctgagcaaccaagtgatacatatgagagggcaagtcctcactactatgacactccagtggaagcttcaaattccaggataccttctctcacatcaggatcacaacttctccatggatctgaggaggctgcgcctagttatgcttttcaaggtcacacatctggttctagcctgttgcctccttccagcaggccccaggtgtttccagtagcaccaacagattatgagatgacccagtttaatagcaaccttagttctgttcctgttgaaggccagtttgatacgtctcaggttgctgcatttgaagacccacctgtatcgtctgaaagaagagcttatcatgatgaagatacttctcgagtggaaagaaaacgaaaacataatgaagaagcaaagattgcaaaagaagttgaagctcacgaaagacgaattaggaaggagcttgagaaacaagattttttgaatagaaagagagaggagcaaaggcacaaggaaatggagagacttgagcgtgagagaagaaaagaagaggagagattactgcgtgagaggcagagagaagaagagaggttccaaagagagcaaagacgtgaaaatgagcgcatggagaagtttttgcagaagcaatctagacgagaagagaaacaaagacaaaaggagcaactccgaaaagagaaagaggcagcaaggcaaaaggctgccaatgaaagggctgctgcacgtagaattgcacgggactatatggaactggtggaagatgagcgtttggaattaatggaattagctgcacaaaacaaagggttgccctcaatgctgtatcttgacagcgacacattacagcagcttgattcttttcgagaagtaatatttcatttcaaatga

SEQ ID NO: 290 - DNA, 471 bp, Zea mays
atggcggccttcaacaagcttggtggccttctaaggcacagtgctctggtgagcggtatcactggtggctcttctcctgcagtgttcaatgctgcacggctcatgtctaccaagctatttattggtggtcttgactggggtgttgatgacgtgaaactaagagaagcatttagcagctttggagaggttactgaagcgagggtgatcacagacagggagactgggaggtcaagaggctttggctttgtgaactactccgacagtgatgctgccaaggaagctatttctgcaatggatggcaaggaaattgatgggcggcaggtacgtgtcaacatggctaatgagagacctgctgggaaccgtggtggtggcggctatggtggcggcggctatggaggtggtggctacggaggtggtggcggctacggaggtggtggctatggtggtggcagccaaagctatgatgcttga

SEQ ID NO: 291 - DNA, 291 bp, Zea mays
atgcagataaactacgcctatgctcgtgacactgaaacactatttgatattattagtgtgaaggtatggagcttatcaggatatccaggaaattttctgcaatttatgtattttggtatcaattatcaatctgccaatcaatcattttcttttgctttcttcgataaacatttattggcaagacagatgaacctctcaattgacaagcgatgcaggataaataatttgtccacaagcatgattgcattatcccaggtgcttatgaaagtttttaccttttcttcaatatga

SEQ ID NO: 292 - DNA, 1308 bp, Zea mays
atgcctgcagatgtagaagcacttgtgacagtggtggtagtggcagtagctgcagctgctgatgatgatggcgcaactgcaaaactaaaaccactggtagaaacagctgggaacgacgacccagatgctgcagaagctgcagccgctgatggcacagtggaggaaccagttgcaaacacagaggctaaagttggtgtagaagctgccgaagatgaaccaaaggaaaatccaggcgtagtgacagacgagctacctattgcactggtagagaacaatgagggagcaggtgcagcctgcgaagtggccaaggagaagccagtggaggacgaggacgccggtgtggttagtgtggtggcggatgatgaaaacaaagaaggagccgtgttcgcggtcgtcgcgcttcctgatgatggtgtaaagccaaacgatggggcggaagcggttgttgctggcgaagaagagaacccaaaggatggcgtggtggtcgcagcagacgctggagaagaagcggtggtggtactgaagaggggcgcagaggtggtggacccgaacagcgacgagccagtggcgccgccaaaccctaaagccggtgctgatgtcggcgtggatgcagtgcttgacgcggccggccccgagttgaacgagaagccaaatgatggtgccggggcggcggccgtggtagtggtggaaccggacgccgacgagccaaagctaaatcccgtggcccctccagagaagaggcttggagtggacgcagcagaagaggcggcgccgaacggactaactgtcgccgccgtggaagaggtggccccgaatgggctcggggtggtcgctgcggaggaagtcccgccgaataggcccgaggtgccaccgaacagactcggggaggttgccgcagagccagtggcggacgcaccgaagaggccggggctgcttgcggcagtggaggtggcgccgaagaacccagggctgcttgcggcggaggtagcagcgccgaataagctaagggttgttccagcggaggatgcgggcgttgcaccgaaaagggatggcgcggacgcggccgatgaggccctgaacagggaggacccaaaagttggagcagaagaagcggcggcggaggatgaggagaagagggaggagccaaaggcgggggcaggggaggaggcagacgccggctgggagaaggagaaggctgatggggtggaggagaagggggaggaggccgtggagcccgcggtcgcggagctgccgaaaccgaaggaggtcgccattgctggggcggggatgatttgggcgagattttag

SEQ ID NO: 293 - DNA, 429 bp, Zea mays
atgggtcgcgtccgcaccaagaccgtgaagaagacctccaggcaggtgatcgagaagtactactcccgcatgaccctcgacttccacaccaacaagaaggtgctcgaggaggtctcgattctgccctcgaagcgcctccgcaacaaggtggctggcttcagtacccacctgatgcgccgcatccagcgcggcccagtccgcggcatctcgctcaagctgcaggaggaggagcgcgagcgccgcatggacttcgtgccggagaagtccgcgctcgaggtcgaagagatccgcgtcgacaaggagaccatggagatgctcgctgccctcggcatggccgacctgcccggcgttgagcgccaggctgaggtctccaacgcccccgcctacggccgcccgcagtacggtggtccccgccgtgaccgcgtttag

SEQ ID NO: 294 - DNA, 609 bp, Zea mays
atgaccagtatatcgtcattatttatttcgctcattccaataatctgtgacacagatggtaagactttcaagaagccaaggcggccttatgagaaggagcgccttgatgctgagttgaaattagtgggtgaatatggcctgaggtgcaagcgtgagctgtggcgtgtgcagtatgccctcagccgcatccgaaatgctgcaagggagctgctcacccttgatgagaagaacccccgtcgtatctttgagggcgaggcactcctgcgccgcatgaaccgctatggtcttctcggtgagggccagaacaagcttgactatgtgcttgcactcaccgttgagaactttctgcagcgccgccttcagaccattgtcttcaagaatggcatggcgaagtccattcatcatgctcgtgtgctcatcaggcaacgccacattagagttgggaggcaacttgtcaacattccctcattcatggtgagagttgactcagagaagcacatcgacttctctcttaccagcccacttggtggtggagaacctggaagggtgaagagaaagaaccaaaagaaggcttctggtggaggcggtgacgacgaagaggaagagtga

SEQ ID NO: 295 - DNA, 1332 bp, Zea mays
atggcccggctcgtgctctccgagtgctgcggcctcgcgccgctccgccgcctgcgcgccggccggggcgccattgcggcgccgtcaccccccgcgctctccgcggcgccgcgccgtcgtcccgcgtccgcgtccatccaccgcgactgggcgctccgcgtctccgcgcccacccgcctcgcctccgccgccgtcgaggaggacaagccgagcgccgcgccggggcaggaggagggcgcggcggccggcggggagttcgacccgggggcgccgccgccgttcgggctggcggagatccgcgccgccatccccaagcactgctgggtcaaggacccctggcgctccatgagctacgtgctgcgcgacgtcgccgtcgtcctgggcctcgccgcagcggccgcgcgcctcgacagctggctcgtctggccgctctactgggccgcgcagggcaccatgttctgggcgctcttcgtcctcggccacgactgtggacacgggagcttctcgaacaaccccaagttaaacagcgtcgtcggccacatactccattcctccattcttgtgccataccacggatggaggattagccacaggacgcaccatcaaaaccacggtcacgttgagaaggacgagtcctggcacccgctaccagagaggctgtacaaaagcctggactttatgactaggaaactgcggttcaccatgccgttccccttgctcgcgttcccgttatacttgtttgcgaggagtccagggaagtcaggatcacacttcaacccaggcagtgatctgttccaacctactgaaaagaatgacatcataacatcgacggcgtcctggctggccatggttggtgttctggccggtctcacctttctgatgggtcctgttccgatgctaaagctctacggagtcccatacttggtatttgttgcttggctggatatggtcacatacttgcaccatcatggccacgaagacaagcttccctggtaccgtggaaaggagtggagttatctgcgtggaggactgacgacgctcgaccgggactacggatggatcaacaacatccatcacgacatcggaactcatgtcatccatcacctcttccctcagatcccgcattaccatctcatcgaggcgaccgaggcagcaaagccggttcttggcaagtactacaaagagccgaagaagtcgggtgctctgccgtggcacctattccgggtgctggcacagagcttgaagcaagaccactatgtcagtgataccggagatgtggtctactaccaagctgagtcgaaaacgagcacctctgcactaaaatccgattga

SEQ ID NO: 296 - DNA, 759 bp, Zea mays
atggcgaagaattacccaaccgtgagcgccgagtacagcgaggccgtcgagaaggccaggcgcaagctccgcgccctcatcgccgagaagagctgcgcgcccctcatgctccgcctcgcgtggcactccgcggggacgttcgacgtgtcgtcgaggaccggcggtcccttcggtactatgaagtgcccggcggaactggctcacggcgccaacgcggggctggacatcgcggtgcggctgctcgagcccatcaaggaggagttccccaccctctcctatgccgatttctaccagcttgccggagttgtggccgtcgaggtcaccggtgggcctgagatccccttccaccccggcagggaggacaagcctcagccgccacctgagggccgtcttcctgatgccaccaagggttctgaccacctgaggcaagtctttggcaagcagatgggtttgagtgatcaggacattgttgccctctctggtggccacaccttgggaaggtgccacaaagagcggtctggttttgagggggcctggactacgaaccctttggtctttgacaactcttacttcaaggaacttctgagtggcgacaaggagggccttcttcagctcccaagtgacaaagccctgctgagcgaccctgtcttccgccctcttgtggagaaatatgctgcagtatgtccttggtcattattatccagggtatggagattcatagggaggcaagtactgattatcgtgtgctctgtaggatga

SEQ ID NO: 297 - DNA, 933 bp, Zea mays
atggcagcggcagcaggcggaggcgcggtgcgtgcgctgtcccagaaggagcaggacatacagatgatgctcgccgccgacgtccaccttggcaccaagaactgcgatttccagatggagcgctatgcctttaagcgccgcaccgacggcatctacatcatcaaccttggcaagacatgggagaaactgcagcttgcagcgagggttatcgttgccatcgagaacccgcaggacatcatcgtccagtccgcccgcccctatggccagcgtgctgtcctcaagttcgctcagtacactggcgctcatgccatcgctgggaggcacacccctggtaccttcactaaccagctccagacctccttcagcgagcctcggctgctcatccttaccgacccaaggactgaccatcagccaattaaggagtctgctctggggaacatccccaccattgccttctgtgatactgactctcccatgcggtatgtcgatatcggcatcccagcgaacaacaaggggaggaacagcattggatgcctgttctggcttttggccaggatggttctgcagatgaggggcactatcctccctgggcacaagtgggaggtcatggtggatttgttcttctacagggacccagaggaagcaaaggagcaggaggaggaagctgctgttgcccctgagtttgccgcaatcactgattaccaaggagctgatcagtggggtggtgaccagtggacctctgatgtgactgcgccgcctgttgctcctactggtgctgattggggtgctgctccagctccggttcctaccggtgatggctgggatcaagctggggcccctgcacctgtggtggacggcactgtacctcctctggttgctcctactggttgggaccaagcagccccgccaccgactgcccaaggctgggagtag

SEQ ID NO: 298 - DNA, 1965 bp, Zea mays
atgaaggggcaccagcaccagcagcagtcgtcgtctccgctgctgccgatgccgccgcccagcaagcgccgctgtagcgcgctggcggcggccgtgccggcgctcgtcgtctgctccacgctgctcccgctcgtctacctcctcgccctgcaccgccccgccgggtatggatcggacgaccgcgccgcggtggtcatcagcaccgagctcgccggcctcggggcgcgtggcagccggcatctggagaacgggggcgccatgaagcacaagctgctcaaggatgtttccaaaaaggtgtctggatctgatggggtttccgctgagagatctactagatcgaggtttagccaggatcatgctgccaaatcaaaagcaaagctcaagggcgctttctctttacttggactgaacaatgataccttcaaaggacctcgtacctccaaaaggtttcagttgaaggacctgtcctggagatcaaaggatactactgtcaatgggaaagagaaccatgatcaagagacagtgcatgaggagaataccaagtcctgtgaacatgaatatgggagttactgcctctggtctactgaacacagggaagtaatgaaggatgccattgtcaagaagcttaaagatcaactttttatggcaagagctcattatcctagcattgcaaaattgaagcaacatgaagcatttacacgtgaactgaagcaaaacatccaagaacatgaacgcatgctgagtgacaccatcacagatgctgatcttccaccattttttgcaaagaagctggagaagatggagcacacaattgtgagagccaagtctagtgaagtaggatgctccaatgttgaacggaaacttaggcagctacttgatataactgaagatgaagcttatttccatacaaggcagagtgcatttctatatcatcttggagtgcagactatgccgaaaactcaccattgcttgaacatgagattgacagtagaatatttcaagtctggatcaaatcatgtggatcagttaaatgaccagaagcttgaaagtcctgccttacatcactatgtaatgttttccaggaatgtacttgcagcttccaccactatcaattcaacggttatgaactcccaggattcggaccacatcgttttccatgtattcactgatgcacaaaacttttatgcgatgaagtattggttcgataaaaattcatacttggagtcgactgtacgcgtaactaacattgaggacaaccagaagctctctaaggatgtagattcccttgagatgcaacaattatggcctacagaggaatatcgtgtcacgattcgtaatcattctgaacctttccagaggcagatgaaaactaagtacatatctatcttcggcctttcacatttcctcttgcctgaccttcttcctggcttgaatagagtagttgttctggatgatgatttgattgtccagaaggacttgtcacctctatggaacctcgatatgggtggtaaagtgattggagcagtccagttctgtggagtgagattagggcagctgaaaccttatatagcagaccataacgtcgatgatgattcatgtgtgtggttgtcgggcctgaatgtcattgaattggataaatggagggacaccggcattaccagtttgcatgatcaatcagtccagaagttgcgaaaggacagcctgaaatcacagcgactgcaagcactccctgcaggtctacttgcctttcaagacctgatatatcctttggaagattcatgggttgagtcaggccttggacatgattatggaatcagccatgtcgatatagagaaggctgctactctgcactacaatggtgtgatgaaaccttggcttgacttggggatacttgattacaagaactactggaggaagtacatgaccagtggagagaagttcatgacggaatgcaacattcactaa

SEQ ID NO: 299 - DNA, 909 bp, Zea mays
atggtttgcatggtggggaattttaaaatgtcttctgtgttgaagcttgtaatgatggaaaatcacgcaacaccagatatgcatatatttggatcaaaaccgatggccgacccattggacttggtctgctgtagtacttgcaagaagccagtcaaagccagccaatatgcaattcatacagggcaatgtagttcagggaaggtaaacacaaatggttcagtgggtgtggatcatgccaatcctacaaagcccctgaagaaaggcagaaaaataaagttgataagtaatggaaatcaaaaagtgcacataaaagtgaaagcaaaatctcaaactgaaagcaataacattgccaatagtttcgagttggacaatggacatgtcactaaagtacaacctatagattccacagggctgggcctgtctgctgatagttcagctactatcaatgtgcctaaaaatcatcccagagatgcgccagttcctcttgcaacaaaaatgtatcattcacagggcaactaccgtcttcgatttgagcttggccagctttatcgcgaatcatgtgtgcagcatttgagtggccacacaactccaaacgtgtcacatgagaatggattgatggcatcatcacggttttcttcttgtggcaactcagcattgcctactcagaagagccttgttcctcaaacaaagcctctcgcagaccctcagcaattagcagcaagcaggcctaaccagtcacaaggaacaaaaactgatagagcaagtgcacaagcatctgcaattaaaaatgaaggttcacgatccagatgcaataaagctaccattccccattcgagaaacaaaggcagcaagaagacgcaacagcaacctaatggacgtgttcatgcgatcaagttcccagtagagtag

SEQ ID NO: 300 - DNA, 294 bp, Zea mays
atggattggattgaaggccagcttgacgatgaatccatatttcctcaaaaacttggcacgccatttccaccgaacttcaaggaagtagtaaagacaatattcaagcgcttgtttcgggtctatgcccatacttaccactcccatttccagaagattgttagccttaaagaggaggcccatctcaatacctgttttaagcacttcattctgtttacaaatgagtttggcctgattgacaagaaggagctggctccacttcaggagctcatcgaatccatcatcgttccttactga

SEQ ID NO: 301 - DNA, 1347 bp, Zea mays
atggtgctgcagcgcttctcgtggccgtacggcggccggagcgccaccttctgcggtagcttcaccgggtggagagagtgtcccatggggctggtcggggccgtgttccaggtcgtcttcgatctgccccccggagtttaccagtaccggtttttggttgatggtgtctggaggtgtgatgagacaaaaccctttgtacgtgatgaatatggactgatcagcaatgaagtgcttgtggaaaacaatgtacaacctgttgtgcagccagagccttctatcagaggaactaatatggataagggtaccattttgaaaacaatgcccccggagccatcatctcagaacccaagcatgcaaatagcagttatccgccatgtggtctctggaatattattacacaataccatatatgacgttgttcccctttctagcaagttaacagttttggacactcagcttcctgttaaacaagcatttaaaataatgcatgatgagggtcttgctctggttcctctttgggatgaccgtcagggaaccataacaggcatgctcactgcatcagattttgttttaatcttgagaaagttgcagagaaacattcaagttattggcaacgaagagcccatttctgcttggaaagaagcaaagctacagttctatggtgggcctgatggtgctgccatgcagagaaggccattaatccatgttaaggattcagataatttagtggatgtggcactgactataatcagaaatgaaatatcttcagttcctatctttaagtgcatggcagattcatcaggggtgcctttccttaatcttgcaaccttacaggggatcttgaaatttctttgctcgaagctacaagaagaggctgagggctgttcccttctgcacaatcagcttctcagtattcctattggtacatggtctccacatacggggaggtcaagtagcaggcaactcagaactttgctactgagttctcctctaaatacctgcctggatattctgcttcaagatagagtaagctcaattcctatagttgatgacaatggatccctccgtgatgtctactcactcagtgatatcatggctctggcgaagaatgatgtttatgctcgcatcgaacttgaacaagtgaccgtacaaaatgctttggatgtgcaataccaggtgcatggccgaagacagtgtcatacttgtttacagacgagtaccttgctggaagttttggagggattgtccattccaggagtgcgacggcttgttgttattgaacaaagtaccagatttgtggaaggaatcatctcattgagagacgtatttacatttctccttggatag

SEQ ID NO: 302 - DNA, 2370 bp, Zea mays
atggggtgcaaggggtccaagcttgacgaccaggaggccgtcgcgctctgccgcgcccgcgccgagctgctcgccgcggccgtccgccaccgctacgcgctcgccgacgcgcacgcggccctcgcggactccatcgactcggtcgccgcgccgctgcaccgcctcctccgtctgcaggctcagccgcgggggctcgtactgccctccgcgcgcaagggcggtggcgcgcccgcgaaccggttgctgccgcgctccttcgacccgtcctcggcgctgcctgcccacggccattcctcgcaaccccagttcggcgcgtcgccgggatccgagccggcgccgacggccgactcgcctccgcgccgccgccgccgcgtacccgagcagctgccgcacccgcattacgccgcgtacgggtacgactacgcgacgcagcccgcgtacgcgtatccggcgccggcgagctcgctgcagttctactacgctcgcagccgcccgccccccgcgtcagtcgccgtcacgcagcgcgcgccggggacgtcggagcgcgtgcactttggctcgttcgacgcggcgggcggctacccgcagcactacgcctacagcgcccagcgggcccaggccccgcctccggttgcgccgcagcggtctgctccgccttcgcctccgaaggcgagctcgtgggacttcctgaacgtgttcgagaactacgactcgtacgaacacgacagctactactacgactccgccacggcacctgctgcgcccgcggcgccgttcatgccgagccggagttcgcgggaggtgcgcgaggaggagggtattccggacctagaagacgacggcgaggaagacagcgtgggcgtggtcgtgaaagaggtggccgggcagtactcagcacctgggaatggcggtgcccgtagccggcgcaactcgctcggcggtgccagtagcaccgccgagctcgaccagccggagaatgctatcgcccataaggacgtcatcggcgagtttcggcgaaggccaacagcacatggtaatgtgtcggtgcacgcgccaccacctcccgcgcggagggtcgtcgacaatgcgagtgtagctggcgaaatcaaggcacagcttgtccgcacggccgaggcggctaggcagctcgcgccgatgctcgaagtcggaaggccaagctaccaaggccgcagctcagtctaccaatgttcctcaaagatgatgtcggctatctccgtggctcatttggggtgcaaagacatggacgtgttggacgtcggagtggtagggaagatggtggacacgcggagcctatcctcggcacttgacaagctctatttctgggagaggaagctgtatgctgaggtcaaggctgaggagaaaacgcgcctacttattgccaagaactccaagcgactgaaattattagatcaaaagggtacagagcctgaaaagatagatgaaactcgaaatttgttgaggaagctttcaacaaagataaggatagctgtgcgcgttattgccaagatttcaagaaaaataaacaaattaagggatgaggaattgtggccacaagttaacgctttgattcaagggtttgtactaatgtggcaagataaattggacgcgtaccatagtcagtgtcaagtgatatcagaagccaaaaactttacttcggttttgtcaggtggaaatggccaggatttggtgttagagcttgaggtagagctgattaaatggatcatcagtttttcttcttgggtgaattcacaaaggaactttgtaaaggcactgaatggatggctagcactctgtcttaactatgagcctgaggataatactactggagctccatcttactcaccaggaagcattggtgctccactggttttcgttacctgcaacaaatggtctcaagccatggatcggatttctgagaaggatgtggttaatgccatgcaagctctagtgtctagcgtgtggcacctatgggagcagcagtatcttgagcaaagtgaacaaataatctcgatgcgagaaagggaaaaatggatcaagattttagagagaagaacccaggatattaataaggaggctgatgagctaaacaagaagttggcgttaataccaagccggcaaaggatgcatgtgcctcggagagtacaactgtatgaggcgcactgtgttgaggcaagtaacttgcacataaatctgaggctggttcttgaagctttagagaactttgctgccaattcactgcaagctttccaggatgtggcaaaaagtgctgaagggacaagactgccaagagataatgtgagaagagagcaccgtagttcggaaagaagttcaaactacaaaactagctag

SEQ ID NO: 303 - DNA, 414 bp, Zea mays
atggtgaagttcctcaagcccggcaaggccgttatcctcctccagggccggttcgccggccggaaggccgtgatcgtgcgcgttttcgaggagggcacccgtgatcgtccctacgggcactgcctcgtcgcgggcctcgccaagtaccccaagaaggtgatccgcaaggactccgccaagaagacggccaagaagtcccgcgtcaagtgcttcatcaagctcgtcaacttcacgcacctcatgcccacccgctacaccctcgacgtcgacttcaaggacgtcgcatcgggcgggcccgacgcgctctccacccgggacaagaaggtcgaagcctgcaaggccgccaaggcgcgcctcgaggagaggttcaagaccggcaagaacaggtggttctttaccaaactccgcttctag

SEQ ID NO: 304 - protein, 544 aa, Zea mays
MLHQENSEAFGRHHSEQLACVNMRGADNGHPNFLPEKCQIAVCPEVHQRGEKVGLFDEELVHGIHLTSPCVQSPFLPSGVKETPIVDHNKRPASSDILDIVECKRLKQEDQIVTKEDNHTSAEEEFHDYPTYTTCERSFDSPLYESEESEDEGVDSPLHCSHARTYVEDGLWPASFHQSVGPFSLRKPVPIGSNHQAELPECRPFGGRTEEDESVKWIRNSVVPMPGTDASSLVLEPVHCKAGCDCLDEGSINCVKKHVMEARENLKDSVGADAFRELGFYDMGEEVASRWSEEEERLFQQVVSSNRASLRRNFWDELPLAFPSKSSKELVSYYFNVFMLRKRAEQNRFDPANIDSDDDEWQAGGDFEFPITGRTDEYMPIESLTDQDDVACNPFPLEGDLYGDSDDEDELDNSSGDRHNGVQRAGMLSEGHPEMSFIDHDQQTLKLDADAQDDSCTSFEAHQVGCDGGAHTDIGNHYRSDDGLCGGAEHGFFGDHCDTKEWGFGFSTGWERHDFLSTNNVIEEVFGKGSSEDGSDTATGQDLI

SEQ ID NO: 305 - protein, 684 aa, Zea mays
MVFQKRSSSELEASGGGQVAEMPRVPKSARGKRSVRKKEAQNPPQMSAFDLLATVAGKLLDEGVGSLGNMSAGAPALTACAKDVRVKKEQCDEEMKQFKHEVTDQDSCNESAILPHIVFQRAVNNARNEDPKAKSEAQDKESSMISCTKAELGCNFGVIADRWSPESVESGAFTGDAVASLMPPAPAGFHKNAPEMYNLLDSMDVDVKPPPLVSSDSTGEMPLYGDKVHRSTSLPRVSKGVGFFAVDRDDDDDKSSGCTHPSTTTNKDFRSNCTAEYSRVRKLLTSKYRKVAPARVYKSDLSYSDVDRKPSFRNKKMHYTRQRTQRSTFKRRKLFDRHSVLASEFGTAHGKGNTKKVTGRDSHAVSLEANKGTSSTPFQKSRGSNDCHVKLKIKSFKVPELLVEIPESATVGSLKKTVLEAVTAILGGGLRVGVLHHGKKVRDDNKTLIQAGIGQEDMLDNLGFSLEPNCTQNPQVQAPEDISFLETIDTAEPLARIAPADSSSKHGEVDLSQEFALTPLAMNYQGSDHDSVHSPGGVSSPDKVSTNSRALVPVPAADPNAGAIVPANKSKRSPEQGQRRIRRPFSVAEVEALVLAVEKLGTGRWRDVKLRAFDNAKHRTYVDLKDKWKTLVHTASISPQQRRGEPVPQELLDRVLAAQAYWSQQQAKLQPKTPPLLAEARLLT

SEQ ID NO: 306 - protein, 606 aa, Zea mays
MHAGTRPSHRHEYGTLAHPTSHTSPIQRPPASRRTLSASDPRVVVQRLHPSPLSSLHPEHKQAAADRTRLVSPAASNWSSAGREGSFSRPVDLRCCALVVVKITIRLLDRAILPFAASPHTSRSKEPKFPARPAGAGGTGIRALPCFYQQLHWPLRFCRRAVHRWGQGSMMRGHTWLALLVVVVLALADAAAGRFVVEKNSIQVTSPDELKGKYECAIGNFGVPQYGGTLHGLVEYPKSNRKACQSFDISFKPKQAGGRPTFVLVDRGECFFTTKAWNAQNAGAAAVLVVDDKSEPLITMDNPEEGKEHLENITIPSVLITKKLGESLKKSAENGDMLSVLLDWRESLPHPDERVEYEFWTNSNDECGPKCDMQMDFVKSFRGTAQILEKKGYTQFTPHYITWYCPEAFVDSKQCKSQCINHGRYCAPDPEQDFSQGYDGRNVVVQNLHQICVFKIANETGKPWLWWDYVHDFALRCPMKDKKYNHDCASDVIKSLGLDIEKINKCVGDPEANEENVILKAEQDAQIGHGKRGDVTILPTLVINNRQYRGKLDKVAVLKAICSGFEETTEPAVCLSEEVQTNECLENNGGCWLDKANNVTACKVQF

SEQ ID NO: 307 - protein, 792 aa, Zea mays
MGIKVEGETYIPGYFDMEDSSVNYNGNVLPYHKENKPSVFLTEKFTIIASNGRVHYDKEMIKRTMLVHEATFRKQVYELHQLYKIQKELMARFQIEEINGCPSYAGLLQPRSSPSQALLDDVKGMRKTVNPISGHDPKQSCIDLINESSSQYSVSGTPLRHNNVRPQKKMIDLQVPADVYTDNDDDVEILEVRPSKRLPGANGSVLLGNVNLSLQNSEGYSHMKSWSTDIQAHHSSTAHILNKPVEDSSSMNRSNFLGVGISALQNHHYASQGVNLNPISLEAKLKEQCAGKASGSRFFGTNEEIRNNNPFQHRKDDSNSSMALYKQNCIGSSMGNYAPNASTFNHSILSPLGFNHALNLPWQSNNTSYLTKSHCGAAETFIPKDALSNGISVDSTPKAPYHHSLKIHGGAGYQKPPALHDNLKDIDLNDTPVDVAATWEQGSEKSVVDISWLSKKPVSLMESQVPSSYAKDHSQILPSPTLYSESRTPTRVPAFPFSVGAEKDSRCSPTLLYDLNNGPSIKHETDMEIQSLCKESDTDTRNLIDLNETLPIIDDPEIESHESGEIVPHEPNGPSQDSIAIAAAAETLVEMWNNSDRPAYQPDILHWFADLAISKDNTLLDKDSDDDFEAATLKLRETKSNEYHSTPRTTQEDNTNFGHCSAASLVSKPQRGRGRGRRQRKHFQRDILPGLASLPKHEVSEDLRALGRSKLVTPTKRGRNRQQPRGRRRARSVAVAMEVEESEVSPPLQASPSPVPADLDADALAITRWGRTTRRCRRPRCPPVNNASLRVA

SEQ ID NO: 308 - protein, 349 aa, Zea mays
MPLEIQDSEVDIVIAALQPNLTTFFEAWRPFFSRFHIIVVKDPDMAEDLQIPAGFDLKVYTKSDINGLLGASSSINLSGHSCRYFGYLVSRKKYVISIDDNCLPAKDTAGSTVDVVAQHMANLKTPATPFFFNTLYDPYRKGADFVRGYPFSLREGVECMLSCGLWLHNADYDPMTHVVKRNQRNTTYVDAVMTVPLGAMLPVSGINVAFNRDVLGPAMFPGLRLRNEGKHRWDTLEDIWNGLCAKVVCDSLGYGVKTGLPYVMRSDAEAGKALESLKEWEGVKVMDDVLPFFQSLKLSRTAVTVDDCVKELAGVVREKLGPKNAIFTKAADAMVEWNNLWKVHGAQNA

SEQ ID NO: 309 - protein, 512 aa, Zea mays
MAAAALAMAEQVVAELRVRCETPPSMLREVAVEMAREMGAGLEKDGGSRVKMLLSYVDKLPTGREEGLFYGLDLGGTNFRVLKVQLGGNAKHVVDRDSREVGIPPHLMSGSSSELFGFIASELAKFVDDDEKCANISNGKKREIGFTFSFPVKQRSVASGTLVKWTKAFSINDAVGEDVVAELQTAMEKQGLDMHVAALINDAVGTLAGARYYDKDVVAGVIFGTGTNAAYVEKANAIPKWEGELPHSGDMKKNDFAVLQVINMEWGNFFSSHLPITEYDQELDKESLNPGEQIYEKLTSGMYLGEIVRRVLLKISLQSAIFGDIDHTKLQTHFLLRTPHISAMHHDETSDLKIVAENFEENLEITGTSLEARKLVVEICDIVATRAARLAAAGLAGILMKIGRDHSVEDQRSVIAIDGGLFEHYTKFRRCLETTLGELLGDEASKAVAIKHADDGSGIGAALIAASQSQYKNDLVAVKHADDGSGVKYAEDKRADDGSEIGAALIAASQSQ

SEQ ID NO: 310 - protein, 127 aa, Zea mays
MGSADRSKIDGIVVPEKGARSCVECRATTTPMWRSGPTGPRSLCNACGIRYRKKRRQELGLEHNKQQQQQQNNGEAKTGVKDSSSNSSSGSSNFHVVQKRRLLMEVEEAALLLMTLSSSPASTLLHG

SEQ ID NO: 311 - protein, 154 aa, Zea mays
MAPKAEKKPAAKKVAEEEPSEKAAPAEKAPAGKKPKAEKRLPAGKSAGKEGGDKKGRKKAKKSVETYKIYIFKVLKQVHPDIGISSKAMSIMNSFINDIFEKLAAEAAKLARYNKKPTITSREIQTSVRLVLPGELAKHAVSEGTKAVTKFTSS

SEQ ID NO: 312 - protein, 675 aa, Zea mays
MDAVELPLPAKVEFGKILAQAAAVEGVDGGIPGGGGGEVLRRCADADRRHDVKQHNQNAEGFPSHRSKRMSLEVSMQKSLGFGLKSDNGKHDYVANDTVQSLHKQDSKIVIKKTIKLLDGPPYPKRPKLEPAQTGRDAEAKGHEFISQKNVPDLTPCTTSEKSRLLKQKRISDGKRTDKKNIRSGVRSKHDCFSSKAGLANFDSGFSGNSVLGAHGLKSDIRDITHHIENLSLIELLDGTYKYSSLGRDKGKKVLHTKEELLVSVRKTFSMLSDMDYRHGKDSNLILSPKLSSASTSSCDIKEQCGDKPPLLVKDPSQINLCDSALCHPKDILSRLTLPHRQDLDSLLAPGRESTAAVKPYMPSMTVHGASLPPFPWSHSQAGGCRQGVDCGKHGSSRSNSQWQWVRVGSNLTSLDHEDTSVHRIDDLLQEMDAAKLCILDPCDGQHNLCGTESTSGSLVQNIHSRKIGGEHGSQQLQPQDHLDSLDGFQKHDIDYSLLKTSQVSPKIQCAAEILCDMRRSTESWIGQGYSNGTIKWPKSPPEKAMKARKPSSQFGTTESSSGSRNNEATWNGSSHSTKKIVDRNNDSARLNNPGKGTIRWPVPVEDNASPVRSERGLMVDMRQPHGNGGRHLVQVSSQTRLEKEYENQQKLRKATLTSSLGSAGDWNREKNRRM

SEQ ID NO: 313 - protein, 677 aa, Zea mays
MDAVELPLPAKVEFGKILAPAAAVEGVDGAVVGGGPGGGSGEVLRSCADADQRHGGDVKQHNQNAEGFPSYRSKRTPLEVSIQKSLGFGLKSENGKRDYVANDMVQSLHKQDSKMVTKKTIKLLDAPPYSKRLKLEPVQTGRDAEIKGHEFISQKNVPDLAPCATSEKSRLLKQKRISDAKRIDKKNIRSGVRSKYDCFSSKAGLAHFCSGFSGNSVLGAHGLKSDVRDITNHIENLSLSELLDGTYKYSSLGRDKGKKVLRTKEELLVSVRKAFSMLSDMDYCHGKDSNLILGPKPPPACTSSCDIKEQCCDKPSPLVKDSSQINVCDTALCHPKDILSRLTLPHQQDLDSLLTPGSESTAAVKPVRGASLPPFPWSHSQAGGCRQSVDCGKHGSSRSYSQWQWVRVGSNLTSLDYEDTSVHRIDHLLQEMDAAKLCRMDSCDGQYNLCGTESTSGSLAQNIQSRKNGGEHGSQQLQTLDRVDSLDGFQKHDSEHSLLKTSQVSPKIQHAAEILCDMRRSIESLSGQGYSNGVIKWPKSPSEKVMKARKPSSQFGITESSSGSRNNDATWNGSSHSTKKFCDRKNDSACLNYPGKETIRWPVPVEGGASPVRSSERGPMLDMRQPHGNGGRHPVQVPSQVARLEKEYENQQKLRKATLTSSLGPPGDWSRERNRRV

SEQ ID NO: 314 - protein, 170 aa, Zea mays
MSSAAGRAPAPTPMGSADRCKVHPSALVSALSSSPLLRALSSRSASCDPPLQIDGIVAAEKATRSCVECRATTTPMWRSGPTGPRSLCNACGIRYRKKRRQELGLDRKLQQQQNNGEAKTDEAKDSSSNSSSGSSNLQVVQKRRLLMGVEEAALLLMTLSSSPTSTLLHG

SEQ ID NO: 315 - protein, 751 aa, Zea mays
MDTAFLSPPLARNLVYDEFAVLHPTSYPFHTLRYLRCNPMYSRPLLTIAPASPSRGLIQRVAALPDVDDFFWEKDPTPILDTIDAPIHLKNLSSKELKQLADEVRSEIAFIMSRKCQPCGADRSVVELTIAIHYVFNAPMDKILWDAGQHVRHLSVTVVLFFSDLLSATLFRSIVFLQQAYAHKILTGRRSLFHTITQKNGLSGFTSRFESEYDPFGAGHGCNSLSAGLGMAVARDINGRKNRIVTVISNWTTMAGQVYEAMGHAGFLDSNMVVILNDSCHTLLPKADGGAKMSVNAFSSALSKIQSSKGFRRFREAAKGLAKWFGKGMHEFAAKVDEYARGMIGPHGATLFEELGLYYIGPIDGRNIDDLICVLKEVASLDSTGPVLVHVITGTENDTGGIIGSEINAVEEGPSNSSPDLLKFLGTGLSRTYNDCFVEALTAEAENDKRIVVVHGGMGIDRSLRLFQSRFPDRFFDLGIAEQHAVTFSAGLACGGLKPFCIIPSTFLQRAYDQIIEDVDMQKIPVRFAITNAGLVGSEGPTNSGPFDITFMSCLPNMIVMSPSNEDELIDMVATAAMIEDRPICFRYPRGAIVGTSGSVTYGNPFEIGKGEILVEGKEIAFLGYGEVVQRCLIARSLLSNFGIQATVANARFCKPLDIDLIRTLCQQHSFLITVEEGTVGGFGSHVSQFISLDGLLDGRTKWRPIVLPDRYIEHASLAEQLDLAGLTAHHIAATALTLLGRHRDALLLMK

SEQ ID NO: 316 - protein, 158 aa, Zea mays
MIVPPSLIQKMYRVLTLGGQGRGAGEDAPPDSRAGEEFGNYVSLRGIKGLAFTCLGSMSKWEPVTFQESLSFVKKVKARDYMLYISLLDVLNRNDQIPLQAYSELSLLFQHHEDLLAELSKFRPLPCPNNVYTHGSIWMIIFLMPFLLLSLVLALRSH

SEQ ID NO: 317 - protein, 584 aa, Zea mays
MAGQAGNPVNHPISPHVISGAFVQQYYHILHEQPDQVHKFYQDSSILGRPDSNGIMAYVTTMRDINEKIMSMDFRNCLTEIETADAQLSHKDGVLIVVTGSLTSDEGVFRRFTQSFFLAPQESGGYFVLTDVFRFISERKPAEINQVATQENEISQNVRPASETCSALPEPIPADGSVISDHVTADSNVTEKQISDLSANGTAIESNDNTQPPVQVPKEDPKKALLVAPPPPTQMDVTKKSYASIVKVMKEGPPTPVVKTTSSVSKQKPAPKPVSTAVEGLEKPSEKPTQAIGTGDGIVAQNNSSRNEQGYSIFIKNLPFHANIEMVEEEFKKFGTIKPGGVQVRHNKVDRFGFGFVEYESQQSMQAAIEASPIRMADKEVGIEAKRANSRGGRFQSGRGVYHGDNFRGRGSGYVDNTNYRSSGSFNRQNEGEMYNRRNEGEMYNRRNEGDFYNHRNEGEFYNRRNDGGENYNRRNDGGENYNRRNDGGKNFSRRNDSGTENFNRRNDGGGENFSRRNDGVGENFNVRNDGVGENFNRRNNFRNQNDFPGRGRGSPTPGNSYYQNGNGRFSRVNNGAKQAPVAA

SEQ ID NO: 318 - protein, 538 aa, Zea mays
MLHQENSEPFVRHHSEQLACGNMRGADNGRPNFLPEKCQIAVCPEVCQRGEKVSLFDEGLIHGVDLTNHIAQSQLVPSGVKETPIVDQNKRPASSDMLDIVECKRLKQEGQIVTKEDNHTSAEDFHEYPTYTTCRRSFDSPLSESEDSEDEGVDSPLHFSHAHTYVEDDLWPASFHHALGPFPLRKPVPIGPNHQAELPECRPFCGRTEEGESVKWIRNGVVPMPDTGASSLVLEPVHCKADCECHDEGSIICVKKHVREAREKLKGSVGADTFRELGLNDMGEEVGSRWTEEEEHLFQQVVLSNPASLCRNFWDELPLAFPSKSSKELVSYYFNVFMLRKRAEQNRFDPVNIDSDDDEWQAGDDGEYPITGRTDEYLPTESLTDQDDVACNPVPLERDLYEDSDDEDELDNASGDRHNGAQRAGMLSEGNRVMSVIEHNQQTFKLDAEAQDDSCTSFEAHQVGVEGGTHTDIADDNHYRSDGFGGGAEHGFFGNQCDTKEWDFGLSIGWEKHDFLSTNNVIEEVFGKCCDTADQDLI

SEQ ID NO: 319 - protein, 807 aa, Zea mays
MASQGEPSSSDPKGKKDYSTAILERKKSPNRLVVDEATNDDNSVVALHPDTMERLQLFRGDTVLLKGKKRKDTICIVLADETCEEPKVRMNKVVRKNLRVRLSDVVSVHQCPDVKYGKRVHILPIDDTIEGITGNLFDAFLKPYFLEAYRPLRKGDLFLVRGGMRSVEFKVIETDPAEYCIVAPDTEIFCEGEPIKREDEERLDEVGYDDVGGVRKQMAQIRELVELPLRHPQLFKSIGVKPPKGILLYGPPGSGKTLIARAVANETGAFFFLINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEVGRLEVLRIHTKNMKLAEDVDLEIIAKDTHGYVGADLAALCTEAALQCIREKMDIIDLEDETIDAEILNSMAVSNDHFKTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEQSRLQIFKACLRKSPVAKDVDLNALAKYTQGFSGADITEICQRACKYAIRENIEKDIERERRSKDNPEAMEEDEVDDIAEIKAAHFEESMKYARRSVSDADIRKYQAFAQTLQQSRGFGSEFRFPDQPTAAAAAADPFASAAAAADDDDLYS

SEQ ID NO: 320 - protein, 59 aa, Zea mays
MRPQNFIRELDLTNLAEDYPKLRELIQRKDEVVAKSASPPMYYKCDLRKHVYNYIFEST

SEQ ID NO: 321 - protein, 1159 aa, Zea mays
MVAEAAPSSSAAIWSLRRDEITFDRLHKFWSALSSRARYELLRLDKQTLIEHARKNLYCSRCNGLLLESFTQIMMYGKSLHHEGSCEPRIQEVEAEVQDPSVHPWGGLSTTKDGILTLLDCFINAKSLHEIQNVFDNARAREREREMLYPDACGGGGRGWISPVMPNYGRGHGTRDTCALHTAHLSCDTLVDFWSALGDETRSSLLRMKEEDFIERLMHRFDSKRFCRDCRRNVIREFKELKELKRMRREPRCTSWFCVADTTFNCEVFEDAILVDWHQSLLEQDGIYHHFEWAIGTDEGKSDILNFENVGMIGQVHRKGLDLDQFEDYFVTLRACRLDGRRTEFCVKAHALKGQSCVHRRLIVGDGFVTITKGESIRSFFEHAEEAEEEDEDDVVDRDSNDPDGDIAHPQKHAKSPELAREFLLDAAAVIFKEQVEKAFREGTARQNAHSVFVSLALKLLEERVHVACKEIITLEKQTKLLEEEEKEKREEEERRDRRRTKEREKKNRRKERLKGKDKDKEKILVRSKKPGLSTFSPSSQAAPSSNESQDVLDLRYSDSEEEDNVVVREHYPDSSADQSSSKDTDERSNEHECSATAEFVPSDCDGSFLCDESNSSRNLRFRWDFPEKDVSYWYEDCRVDSGDTQLQSRERIRNNTRSYNTVFNTNNRTRDKYNPCSCGHQEDFRYFSTATRSSRETKISRKTVAEKPRLQYRRCYPPESFAVSNGRVGGTPNKNTGPKQVWEPMDARKKIGNGRGSEITPETTGAADGSDQVECSKDISECEKLEVVCETLAETCCEISAEACKSDQPCRQGEKNQSACSDGSKCVDKPNCCLTKDTVRTTNLTSSDSFSCLSEGDRDSSMSSMTSLSAQNVESSSTSDSDEYSDRNDSSPGDPPVKNVSRSLLEMCAGNGFREYQPKGLNPPNGNQFGFMVAPLQDQMLHQQKIHAPPYSSPFVGFHNHPLAVPTNGYLPYPQPGHFYPGLMTPVGCGVAGSQCVDFPMQYSNNIHPYSGPEFGFLPAKPVHKTPVSFHAVPVPPLAPLCRSEVPVVINQERQQGSAPPKFKQAVLVPENGCSAEDNTFKQKGDDTDSTPFSLFQFNLPIAPPTLATSKEEQSGAMPSMALPPAQITRAQLCSREETNVKEYNLFSGCNGVMFQLN

SEQ ID NO: 322 - protein, 334 aa, Zea mays
MGEASPSIAKDVTELIGNTPLVYLNKVTDGCVGRVAAKLESMEPCSSVKDRIGYSMITDAEEKGLITPGVSVLIEPTSGNTGIGLAFMAAAKGYKLTLTMPASMSMERRIILKAFGAELVLTDPLLGMKGAVKKAEEIQAKTPNSYILQQFENPANPKIHYETTGPEIWKATAGKIDGLVSGIGTGGTITGTGRYLREQNPNVKLYGVEPVESAVLNGGKPGPHKIQGIGAGFIPGVLDVDLLDETLQVSSDEAIETAKALALKEGLLVGISSGAAAAAAVRLAKRPENAGKLFVTFGVGGGQTQWFRQRNIIGAALLSDGFSEFLSPELGCDF

SEQ ID NO: 323 - protein, 703 aa, Zea mays
MPVIFHLAMPPLRAAPRFLTQFLPIWLYIYTHTFTHPSSACLSGGLKTCIRSLCACCMGPPRPASPACATAGVTVKVSDRYVEIKNGIFDLTLSNPDGIVTGVRYNGVDNLMEILNKEDNRGYWDLVWNPPGQKTGIFDVIKGTEFRIVYQDENQAEVSFTRNWDPSLEGKAVPLNIDKRFIVLRGSSGFYTYGIYEHKEGWPDFGLGETRVAFKLRKDMFHYMALADDRQRIMPMPDDRLPPRGQPLAYPEAVLLVDPINPELRGEVDDKYQYSCEDQYNNVHGWMSFDPPIGFWQITPSDEFRTGGPLKQNLTSHVGPTMLAMFLSAHYAGDDLSPKFTNGEYWKKVHGPVFMYLNSSWDASDPTMLWEDAKVQMMIEKGNWPYCFALSEDFQKTEQRGCVSGRLLVRDRYIDDQDLYASGAYVGLALPGEAGSWQRECKGYQFWCRADVDGSFYIRNIVTGNYNLYAWVPGFLGDYKLDATVTIASGDDIYLGDLVYEPPRDGPTMWEIGVPDRSAAEFYVPDPNPNYVNRLYVNHPADRFRQYGLWERYAELYPDSDLVYTVGQSDYSTDWFYAQVNRKIDDNTYQPTTWQIKFDLDSVSPSSTYKFRVALASSALAELQISFNDQDRAVPHFATGLIGRDNAIARHGIHGLYWLFNIDVASAWLVQGVNTIYLKQPRSQSPFQGLMYDYLRLEGPCGC

SEQ ID NO: 324 - protein, 505 aa, Zea mays
MGLRVAATAPAPAGVRVLGRGAARVTPRPWAAVGGRRRFSVRMSVATTEATTTIAVGASEDQALEARNSKTVVAVILGGGAGTRLFPLTRRRAKPAVPIGGAYRLIDVPMSNCINSGINKVYILTQFNSQSLNRHLSRAYDFSNGVAIGDGFVEVLAATQRPGTEGKRWFQGTADAVRQFDWLFDDAKSKDIEDVLILSGDHLYRMDYMDFVQSHRQRGAGISICCLPIDGSRASDFGLMKIDDTGRVISFSEKPKGDELKAMQVDTTVLGLSKEEAENKPYIASMGIYIFKKDILLNLLRWRFPTANDFGSEIIPASAKEIDVKAYLFNDYWEDIGTIKSFFEANLALAEQPPRFSFYDADKPMYTSRRNLPPSMVNNSKITDSIISHGCFLDNCRIEHSVVGVRSRIGSNVHLKDTVMLGADYYETAVERGELLAEGKVPIGIGENTTIQKCIIDKNARIGKKVVISNSEGVDEADRTSEGFYIRSGITVVLKNAIIADGLVI

SEQ ID NO: 325 - protein, 202 aa, Zea mays
MVSSSSPVVNVYPLANYTFGTKEPKMEKDTSVADRLARMKVNYMKEGMRTSVEAILLVQEHNHPHILLLQIGNTFCKLPGGRLKPGENEIEGLKRKLCSKLAVNSPSFPPNWQVGECVAVWWRPNFETVMYPYCPPHITKPKECKKLFIVHLSEREYFAVPRNLKLLAVPLFELYDNVQRYGPVISTIPQQLSRFQFNMVSS

SEQ ID NO: 326 - protein, 1192 aa, Zea mays
MEAAASSLSTLLSTLRVNGPWTPPGTWESVIPESGAARVSHLGGRPRLQPIYELASVTDDALIHLALHALYGVKTSLDEIEELSALSSSNPADRTSNRVPNVWLRSSSTTSMGSILKSFRSTGLAVFFLCKFVHFYLFQSREMNCASREVHEHEDSGDKDTKQHQPYTLVNQAFAAAVNKVLEGYFCSLNTLLASIRLRRSVGQSGIASKISNGMSCDPTSEVTLLEVYLHTEELRRHVKSLGNICFPKFAGLTLCQEGLNTDANVEFENFPRGTDLLSYLYVHIRDADPVHYGLLKYLFIRSCEPYFNFIKSWIYRASVDDPYEEFLITQTENKGAQGISSDITDDFILFPLKGRNHVSAPCFLKEICHPLLRTGQQLQVLMNLLKYCNLAATEGDVYPSRNIIHMEGVLPWFDTPIESSMNSFTFSKSAIEALTCKRDAMYKLMMEKLQHFFSNVEVIAFDTASNFLHKRTDLVDASVSDAELFYGDSDAVLPCNMAADEKDDSSSNSQESSDKEDPLESSECSSYTSMDDTEVESSTACENLSSSMFSLYCTSTGEAKGSLVTSKLLSSQSSSVDHGINCAIPIECEKDDRLSCKHVLVHPQNTKHTAVPDGSELDYQYSQFSPFDRFMKRASCSFESMNSVGEFLYSDHKRSVGNAVYPLHSESGSTKLSNSKNYEKFVTINQPWNTSIPYNLSLNPILKNAACYHTESDMQQKSKNQSLASFDFESVMDPCEVYCARSPSLLVESVNGAATAGQPSTQPYEQPDCSTKLLQAQTRSQSSLTSSGEMSTGDSLQKNASGGAFWEISLLYNDKSKEKPAMDFSSQFDMPLDIVIDKCIIQEILLQYKYVSSFTMKLLEEGFDLCAHLLALRRYHFMEIADWADSFIASIYQKKWSFVKSEQKRSEIQGLMDLALQRSSCDSDPYKERLFIYMRESPVDSVDASPCGLDLLDDILLGYKAEWPMNIVITVDALKIYAEIFCYLLQVRFAVFSLTEVWRFLKELTQFIGRSSHSRSDVLKKLNFVMKLRHKLYHFLSTLQQYLHCHLSDISWRRFQHSLKNQVRDILDLEYVHICYITDALDICFLSDESKQVATIIKSMLQLALELRSCFQSGDTCDLSVNQLSNLQYLINFSQVDVIRTKFEDNIKDLYILHSKSSKYTELGLSRFWGYLNYNEYHSTKVSKDMDNFYF

SEQ ID NO: 327 - protein, 161 aa, Zea mays
MWRKRLIQRNMPALRFKTCRLLPGNVRNRELSLIQRRILRRLRNKRRSIKRNLSQRENLNSNIKSQTTRKLSLYYGYLPIREMHRGRERTSYIPFLLNQETRSDVIPVRLRFSDTLPQARQPISHRRVCLNNGLVTITHFKVSHGDLISLKKMTREPAVKK

SEQ ID NO: 328 - protein, 415 aa, Zea mays
MEVSRWTPAAGLLLLLLLPLAATPSRAATMARSPSSSTAVFQLQGDVYPTGHYYVTMNIGNPAKPYFLDVDTGSDLTWLQCDAPCRSCNKVPHPLYRPTANRLVPCANALCTALHSGQGSNNKCPSPKQCDYQIKYTDSASSQGVLINDSFSLPMRSSNIRPGLTFGCGYDQQVGKNGAVQAAIDGMLGLGRGSVSLVSQLKQQGITKNVVGHCLSTNGGGFLFFGDDVVPSSRVTWVPMAQRTSGNYYSPGSGTLYFDRRSLGVKPMEVVFDSGSTYTYFTAQPYQAVVSALKGGLSKSLKQVSDPTLPLCWKGQKAFKSVFDVKNEFKSMFLSFASAKNAAMEIPPENYLIVTKNGNVCLGILDGTAAKLSFNVIGDITMQDQMVIYDNEKSQLGWARGACTRSAKSILSSFP

SEQ ID NO: 329 - protein, 1677 aa, Zea mays
MGTGGWRRGSNGLEQWAEAMERRRLEHWAATLAAAHCPVPLVHYCQQLGSTLHSHETCFTQTADSLFYMHECLQQARAPMFDVPSAIEVMLTGGYQRLPRCIEEIGSQHKLSPDEEKRALRKLDASVRYRVLVTPRPKEVSNVSVTDGIAVFRVDGEFKILLTLGYRGNVDLWRILHMELLVGEKKGPIKLDESRRFALGDDIERRMAASENPFAVLYAILHEFCISLAMDTIIKQANVLRQGRWKDAIRSELISDSATVQTGNTPLMQLVQDAEFDSSGFKIPGLKVNYWLDEKSTSTAEPDSSPFIKIEAGLDMQIKCQHSSFILDPFTDKEASLSLDLSCIDVEQLILRAVSCNRHTRLLNIQRQLCKNVQIFQSPKDVVLTRDVAAAKDPMMNAEKGFSDCFGNEVLQVRACGQAYVSLGINIRSGRFLLQSPENILPRAALMDCEEALNKGSTSATEVFSSLRTRSILHLLAATGSFFGLKVYQQSQGTLKIPKTLLHGSDLMVMGFPHCANAYYLLMQLDKDFRPVFHLLETQCDANGNTNASGDVKEAIRYNKINIGQMQILKNEMNENPFDVKLQALQSLVDSADMMESDLPVQNAIEPLPLLPACSPSFSSIVDEVFEYERGSTAAQNRCLPVDIQGINARVVSPMHDGCLSYTQANNNMNVHPNVSLNSYFPSNFRHLQGTNTFSSNPVMSMTKLSGSNSNHDLCSLSSPYDYDIAGANKSLQLVPSRLGKLITAGSDGASRKHYLSDFLSSIPSLRGLQPSEPRKRRKKTESVQSLLPLQAHSSNLQSRGSLTYGDVLAERNNCVPATIYASVLLHVIRHCSLCIKHAQLTAQMDSLAIPYVEEVGLRRPSSNLWLRLPFAQDDSWNHICLRLGKAGSMSWDVRINDPHFRELWELNGGSTKTQWGVGIRIANSSEMDSHISFDSSGVVLTYNTVEADSVQKLVSDLRRLSNARSFALGMRRLIGVKFQDKLDDNQLTMEVKSQSVNKGNSDAADKLSEQMRKTFRIEAVGLMSLWFSYGTMPMVHIVVEWEIAKAGCTMHVSPDQLWPHTKFLEDFVNGGEVASFLDCIRLTAGPLLALGGAIRPARMPVAVSSGYSSMPKQPNIPTQGPLVNGSSSTIHHAPGPSNAASAHLGSHNLHAAAMLSAVGRGGPGLVPSSLLPFDVSVVLRGPYWIRIIYRKKFSVDMRCFAGDQVWLQPATPPKGGPSVGGSLPCPQFRPFIMEHVAQGLNALEPNFMNATQASGHLNNNAGVPQTAPSANRLNATPGVSMVRPTSGVANHVAASLSRAGNAMLASSALASGISGTSVRLTAGAGLPVHMKGELNTAFIGLGDDGGYGGGWVPLAALKKVLRGILKYLGVLWLFAQLPELLKEILGSILKDNEGALLNLDQEQPALRFYVGGYVFAVSVHRVQLLLQVLSVKRFHHQQQQQQAQSNAQEELAAVEINEICDYFSRRVASEPYDASRVASFITLLTLPILVLREFLKLITWKKGLSPVHGDIATAQRARIELCLENHSGSASSDNTENSSLAKSNIHHDRAHSSVEFALTFVLDHALIPHMNVAGGAAWLPYCVSVKLRYSFGDNNHIAFLAMNGSHGGRACWLQFEEWERCKQKVSRAVETVNGSGVAGEVGQGRLRMVAEMIQKQLQLCLQQLRDDPLSAGSTAS

SEQ ID NO: 330 - protein, 300 aa, Zea mays
MQKKPDDAMEEEAAAAPGPEIGFWLAARRRLAPEDPFFAAGDLERELLAKHLALDLSEDDRNQLEKMEVASTCTVFCPIAGCGAHLDCLEEFEDHYVTRHTASCSVCSRVYPTSRLLSIHVSETHDSYFQAKVARGFPMYECLVEGCGMKLKSYKSRQQHLIDKHQFPKSFEFFKKARDSQRQRQKSQRRQTAHKGEETRDNSMDVDGKGARQTNRRYRLKQHDHSEPKENKQQHKEAQEDEMEVEQKIDELTSAVSRLSTADSTPSSVTFGHRRSRGLTFVPRSIRQNKQAALPAGSNK

SEQ ID NO: 331 - protein, 218 aa, Zea mays
MVKLTMIARVTDGLPLSEGLDDSRDLKDADFYKQQAKLLFKNLSRGQHEASRMSIETGPYLFHYIIEGRVCYLTLCDRSYPKKLAFQYLEDLKNEFEKVNGSQIETAARPYAFIKFDAFIQKTKKLYLDTRTQRNLAKLNDELYEVHQIMTRNVQEVLGVGEKLDQVSEMSSRLTSDTRIYAEKAKDLNRQALIRKYAPVAIVIGIVVMLFWVKNKIW

SEQ ID NO: 332 - protein, 676 aa, Zea mays
MEMCRGGRKGSRAAETLPMAAIAGLGHGDASAGAGADGDVQRWEEGIAGGRDLADVIFTNESNIVRWKNKRQQAVDSKVGRLDNFIECVKAPIQEVGVPKIPMIYGRVGVIALDNARQSAKIIDQSLTPGKIYDGDGFNYIKESFENGTLHLIGLLSDGGVQLSYKRTTRFTFICSIQLLLKGVSERGAKKIRVHNLTDGRDVLDGSRVGFVETLENDLLELRGKGIDAQIASGGGRMYVTMDRYENDWDVVKRDWDAQVLEEAPYKFKSALEAVKTLRAQPKANDQYLPPFVIVDDSGKAVGPVLDGDAVVTINFRADRMVMLAKALEYADFNNFDRVPVPEIRYAGMLQYDGELKLPNRYLVSTPEINRTSGEYLVKNGIRTFACRQPGKTTRSSSHALPPPYFSLLDTPPATDIPYRQVPFPRLALVACFRPAHLPPVLAMGAGANNHEESSPLIPAAVAAPAYEKPPQAPAPEAANYYADGVPVVMGEPVSAHAFGGVPRESWNSGILSCLGRNDEFCSSDVEVCLLGTVAPCVLYGSNVERLAAGQGTFANSCLPYTGLYLLGNSLFGWNCLAPWFSHPTRTAIRQRYNLEGSFEAFTRQCGCCGDLVEDEERREHLEAACDLATHYLCHPCALCQEGRELRRRVPHPGFNNGHSVFVMMPPMEQTMGRGM

SEQ ID NO: 333 - protein, 649 aa, Zea mays
MAGKGDGPAIGIDLGTTYSCVGVWQHDRVEIIANDQGNRTTPSYVAFTDSERLIGDAAKNQVAMNPINTVFDAKRLIGRRFSDASVQSDIKLWPFKVISGPGEKPMIVVQHKGEEKQFAAEEISSMVLIKMREIAEAYLGSTIKNAVVTVPAYFNDSQRQATKDAGVIAGLNVLRIINEPTAAAIAYGLDKKATSVGEKNVLIFDLGGGTFDVSLLTIEEGIFEVKATAGDTHLGGEDFDNRMVNHFVQEFKRKNKKDITGNPRALRRLRTACERAKRTLSSTAQTTIEIDSLYEGIDFYSTITRARFEELNMDLFRKCMEPVEKCLRDAKMDKSTVHDVVLVGGSTRIPRVQQLLQDFFNGKELCKNINPDEAVAYGAAVQAAILSGEGNEKVQDLLLLDVTPLSLGLETAGGVMTVLIPRNTTIPTKKEQVFSTYSDNQPGVLIQVYEGERTRTRDNNLLGKFELSGIPPAPRGVPQITVCFDIDANGILNVSAEDKTTGQKNKITITNDKGRLSKEEIEKMVQDAEKYKSEDEEHKKKVEAKNSLENYSYNMRNTIKDEKIASKLPADDKKKIEDAIDAAISWLDANQLAEADEFEDKMKELESLCNPIIAKMYQGAGEDMGGAGGMDEDAPAGSGGPGPKIEEVD

SEQ ID NO: 334 - protein, 2502 aa, Zea mays
MDLAGMKRRELQALCKRHGLPAGGTNADLVGRLDAVLSGPAVVEEEVAGVPARKGCLKQTGGGATEAKKVTFGAEVGKARRLRSRVIWSPVVAKTRGKSARAGTDSAAEDGISADVGADVPVRRSRRNSFNPAEAEEAGEAVAVDRKPKRKNQENDEGVAVIAQARVTRRSNLEWSATVLPPAVEKKRGRQNAAESDVQKSALVEVTARTTRSRSIVPVVVPPTVVENKRRKTGDPQTTVELTMLSDVPRSDFPATRSLRNKIVHVNNSVVDETHTTRQLENKMRPSTRRHQQVASSPEDKGQKIPATSKSPLLRWSRRNYSEANSANSVNIKLAKDSSTAQPLAHHNSHSEDLEKQPAVKEPIKRSTRKSIALAALEKEKDVIEGKNPEAHVRRSTRKSVVQVKDTKSIVEETQYANSEDVAKQPATKGPARGLRRKSVITELHEKEKSLIAEKNMETDEAILTRKPVIPVKNIKAVGEGIQIGKGKDVDKQFVVKQPTRRSSRKSVLPDMLENNSGLLAPKMNAEMNVRRSTRKSVLPDMHNEKQDHHKMARNENLQSGKYQDGEKQQKVKDSIRQSRRSIATVLLEGQNNDEGKKFKNPTRRTTHKSHALNAVEEVSMDHIEVGEEGLKLRKRSRFLLEISSSANVSWKHQNAQISNEKDNTEGSQQASNCTTSKRRSSKKRRTTAPEEVMPFKVANDDIVIMEETKDTLEYNNESSSKVQEICQVNAAREEFSSGPLLVTVAPSDEICTVQSVAVVIPGSESGDDANQSSDKSKQPQEHSVTQTVDDHLSETRSGKLDQSTCITGLVSDNCVVSEDKTLMSEGEGDFVGPKSPNGLSISFIVADREEQSPVSGEQRVSLEANANEPEEKNLANVTSTDLHTKSLQHDIDRIAKETDKDVLSLVFPIEEHEEKYGVSPIAVEKCVCREASACESARKPLTVIFSNNLHTKHLQHDCDVLIKETGEEVLAQENCNDQPVPAQTDQEIKLNDELADPDVLAQENCNDQPVPAQTDLEIKLHDELADPDHEEQSPVSGERRVSLEANANEPEEKNLANVISIDLHTKSLQHDNGRIAEETDKDVLSFVFPIEEHEEKYAVSPIAVEKSFRQEASAIESAGKPLTVIFSNDLHTKHLQHDCDVLIKETGEEVLAQENCNDQPVPAQTDLEIKLNDELADPDVLAQENCNDQPVPANEPEEKNLANVISTDLHTKTLQHDNDRIAEETDKDHEEQSNVFGERRVSLEANANEPEEKNLANVISTDLHTKTLQHDNDRIAEETDKDHEEQSNVSGERRVSLEANANEPEEKNLANVISTDLHTKTLQHDNDRIAEETDKDVSSLVFPIEEHEEKYAVSPIAVEKSVSREASACESAGKPLTVIFSNDLHTKHLQHDCDVLIKETGEDVLAQENCNDQPVPAQTDLEMKLNDELADPEVLAQENCNDQPVLAQTDLETKLNDELADLAMESGCSITERNEGLVAHNLDQEGFLEATPECKQECGLPEETVISSKETGSLLCADQSPIGLESLFSQESIVESVGHCALASATTHTENGFDDSKDCHNKSALENVHVPEPCSHNDTKGGIFKNVDCMHTSQRDDRMEGVPEANTDEEHVLSAFLLDANHLNVVINSEEVVCEGEDSKELLHSEDCKASSEKTDVNDGNVYGISDAVVRCALHAPADDNYEIFLGPNTDVPRQVYNDGCSDVKEDRFASKPWTIDIIEDASVKERSNLKDWQLDSKLEGTEIVESGLYFNKDIGNILHSGSIGEITPSGSGLSKDSSVDYRGEVLDGFSMEASLERSSTRGEQNGCRLDAIENPSITLATSGYKHEGALSEEAVYTKKNYAGTCLSNPRELIMELQSHFSKENINESDPHDSLVFPTAENSADEQLVKVHHGSNLSQLGLTDLLDGPIGCSNTDVLCQCDNHKNQSNEDKVEEVEAVSAAKYIESEVVLLPSQERSNLNNEQLNTKLESPNIMGSCLNCDNDVCNTSDNGSVFVIGKRTPSASGLPEDYPKDSDLQQPVLDSFSVVSSFQDNISGKKTVSGVAGSEILSLSLATPDYKHEDGFSEEAVCRTKNYTGTSSVDPRHLDMEGHSIYSEGGTEKSNLQDNLAFLSAESGKDEPIICHVEKLVDAHASSDTYQGPCQDLGRHEEQESCMSIPMQAKESGGVLRSSHTKGSVTAAQIDLAGDAHLIVSDNAAAKQVFSEEKEETKSISSSDIDILHEKSYSSGHDDHAACAAETQFYHPQKASISDGLHLGPSSLQVESLDALDSDILYVNTGVLEQHHKEGYYEPSVYQITSGICTMSEAEPFEVLETGKDVKTPSKLDEQLNPGLDGDEAEKHSLDCGTDTSPVMSKRTLSSPGSGPCQQYVNESTTSTQSTDNHPNDLPAPRSPEQSACFQNDNDSGSVGICQSSRRRGIDELCGKLQSFKVSSAVKGSYVAMGAPRPKPGDSTSRSAAALLRNIENTTAVKAGRPPVKPNADGKDSSRRALQPISGRPDSR

SEQ ID NO: 335 - protein, 437 aa, Zea mays
MDGQAPPLLDAVVLEPLAVGDELHPRRPVEVEDAPAAAPPSGMDGQVPPLYNVTRDPLTVSDELQPTGEVVDDALLVAPDIVKGEVMEDDILPVATDIINDAASECPEAGSDGVVLTDELRNRIVKQVEYYFSDENLPTDEFLLNYVKKNNKGFVPIEIIASFRRMKKLVQDLSVIEAALRTSSKLVVSSNGKRVRRLHPLPHKELKDSKKSTVLVENLPPDFSMESIQEKFATVGKVVNITINDPESVKEFSTAKKPDFNLSFKAHVLVEYEAVEAAEKAVTALSDESNWRTGMKVRLLSKQSVMGPGKYKKPSKENQDAVSKMIDQNQHSKEDQLKTLEKISGADAVGITKDRDNLKPVFITETEHQDQKPNARGRKGWYKGQGQMQQNANKQGSCGSESLNKPISGPRMPDGTRGFTLGRGRSLPLQKSEKAEE

SEQ ID NO: 336 - protein, 286 aa, Zea mays
MPKGAKKRAKLKKQQQQGHPDDAGNTNASNGNCNGCDDNNSASSGRDGDHHLRIPPKVSRVDANEDSMESSEEMVTPRAAASEPDEEETKATAAEVPVERTVDADVAGSGEVIVDAFPPETVGQEREGKVDEAEVEVHAVVAQEPEVKDVVVAEESVVQEPVSDAPVAEASEVKELAKVHSVLESEPRVDEGRDEVVVVDETPVVPEVQEPEVKGVDATVVLKEQEKNSGNVVAKDSAEVSRSQEAAGVHITEVERGPAVAVIAPGQRAIWWNFCGLFDAFTGSGR

SEQ ID NO: 337 - protein, 789 aa, Zea mays
MAQQLPCVSSPRPLLAVPAGRWRAGVRGRPNVAGLGRGRLSLHAAAARPVAEAVQAEEDDDDDDEEVAEERFALGGACRVLAGMPAPLGATALRGGVNFAVYSSGASAASLCLFAPGDLKADRVTEEVPLDPLLNRTGNVWHVFIHGDQLHGMLYGYRFDGVFAPERGQYYDVSNVVVDPYAKAVVSRGEYGVPAPGGSCWPQMAGMIPLPYNKFDWQGDLPLGYHQKDLVIYEMHLRGFTKHNSSKTKHPGTYIGAVSKLDHLKELGVNCIELMPCHEFNELEYFSSSSKMNFWGYSTINFFSPMARYSSSGIRDSGCGAINEFKAFVREAHKRGIEVIMDVVFNHTAEGNEKGPILSFRGIDNSTYYMLAPKGEFYNYSGCGNTFNCNHPVVREFIVDCLRYWVTEMHVDGFRFDLASILTRGCSLWDPVNVYGSPMEGDMITTGTPLVAPPLIDMISNDPILGNVKLIAEAWDAGGLYQVGQFPHWNVWSEWNGKYRDTVRQFIKGTDGFAGAFAECLCGSPQLYQAGGRKPWHSINFVCAHDGFTLADLVTYNSKYNLSNGEDNRDGENHNLSWNCGEEGEFASLSVRRLRKRQMRNFFVCLMVSQGVPMFYMGDEYGHTKGGNNNTYCHDHYVNYFRWDKKEEQSSDLYRFCRLMTKFRKECESLGLEDFPTSERLKWHGHQPGKPDWSEASRFVAFTMKDETKGEIYVAFNTSHLPVVVGLPERSGFRWEPVVDTGKEAPYDFLTDGLPDRAVTVYQFSHFLNSNLYPMLSYSSIILVLRPDV

SEQ ID NO: 338 - protein, 910 aa, Zea mays
MAAVEPRQFGRLEPGSSPVRVATNGAKAYPPPASHLPRRADSPVRGCSFPPLVSPPRRLDDASDDEDEEQEDWRELYGSHLQLEVEPAVQDARDEGTADAWIERNPCLVRLTGKHPLNCEPPLARLMHHGFITPAPLHYVRNHGAVPRGDWATWTVEVTGLVRRPARLTMEELARDFPAVEIPVTLACAGNRRKEQNMVQQTVGFNWGAAGVSTSVWRGARLRDVLRRCGIVPRKGGALNVCFEGAEDLPGGGGSKYGTSVTREWALDPSRDIMLAYMQNGEPLLPDHGFPVRVIIPGCIGGRMVKWLKRIIVTPAESDNYYHFKDNRVLPSHVDAELANAEAWWYKPEYIINELNINSVITTPGHDEILPINSITTQRGYTMKGYAYSGGGKKVTRVEVTLDGGETWLVCHLDHPEKPNKYGKYWCWCFWSVEVEVLDLLGAKEIAVRAWDQSLNTQPEKLIWNLMGMMNNCWFKVKVNVCRPHKGEIGLVFEHPTQPGNQPGGWMARQKHLETAEAAAPGLKRSTSTPFMNTTDVGKQFTMSEVRKHASQESAWIVVHGHVYDCTKFLKDHPGGADSILINAGTDCTEEFDAIHSDKAKALLDTYRIGELITTGTGYSSDNSVHGGSVLSHLAPIREAVRAPALSNPREKIHCRLVGKKELSRDVRLFRFSLPSPDQVLGLPIGKHIFVCASIEGKLCMRAYTPTSMVDEIGHFDLLVKVYFKNEHPKFPNGGLMTQYLDSLPVGSYIDVKGPLGHVEYTGRGSFVINGKQRHASRLAMICGGSGITPMYQIIQAVLREQPEDHTEMHLVYANRTEDDILLRDELDRWAAEYPDRLKVWYVIDQVKRPEEGWKYSVGFVTEAVLREHVPEGGDDTLALACGPPPMIQFAISPNLEKMKYDMANSFVVF

SEQ ID NO: 339 - protein, 895 aa, Zea mays
MPPPSASASPSASRFAKHWIADVLAGEESVDFSLLKVLVGASSKPLAGAPEATRERVALRSIQEVLSVIAAGGDAAATAGVLSVDGARSCEDGLFRLIREVGSFGELEKDLLPPFSQDIQENICTKKFTLPGISFQLLERVEPWIASMAPQPQMEHNGTEQCVNDQSLRSSHGCVNIEKPVFHTDNAGVQQETMADVVNESETGNLQKDPPAPTFIFHQPCMPESRSYVPPQEDTIDAVGLGARSSERSPIVEGNMSVGSVLASDGCDVPLQGSITEPFFQQDKHDHTVIVGPKSCKRKSPIPSYCAHGDGADGGGSSNQSSKVSIREGPSTHATVTSGFDRISDVLPTDAPESEHLPECITAQDTTISQPDSRKAHLSALQQERGEKVTQDLEDISANIGSVEKDHIHGDLTLPSASVLLSISCNGANQGSKYETNLQPGTATEDMMAFEEQNADKSHLEVSGINKANQALHDDGGVMKNNTVHGGLIVQTAPVSQNCNVTLHDKTSEQENEKNIQKDNCHTYVPGSSQDRGGESAKKTTNELKSGDISSKICVHFNVQDINDTLEDLSQQGLCIKCGEGGQLLECNGCFLAAHSSCFGSSATFEGTNFFYCPVCLYKKATEAYKKAKKTYCETRKNLVAFLGTAQATNQPDKQLNGAQPGAANRDEEPHDEQHSKGCGASKGAHENEVYNLAHQDEEHHQQRKKQKINAIGKSYPKEVLTEKVIFQNSDPASINKHSVLQNNNKTPVKDPEKKQQAVNEEARKEGGNDNSSHETGASSPRRCDPPSNQDVEADQDDSLTTSNQSGGSDEIEATSSNDSAKQSSPPWRGMGHNKKGLHEKEPAVSSKSGKGIGKQDQHMHTSRRKKKMHTCKSAIPILLRHLEDANNSVGQKKK

SEQ ID NO: 340 - protein, 69 aa, Zea mays
MFCDITTIFCCYEFTTCMLPRPVSVGAFIYFWLICDMSIFFINTSSVVDLQYITTLDEPNHHTVMLPFL

SEQ ID NO: 341 - protein, 860 aa, Zea mays
MEREDADGALDSWAQFCTLSNELLAGDGDLAVGPRLAPVVGDLCTRGLATLVRDYFLHSLEETFRNHAVKKFWQHFHPYCSASTVDRIKFCVKEHWPEEILSKALEDICLERGYQEKCVLVLVQVLQSYEDRMPRKKIKEVVCSSSLMPRYQLMVSSVLLTTLPLSFPDILNIYFKKKLEELNSIMAGSYESDQLVDHEPFQRSNTSDWHSGMDIDGSEVSENSSLVKNIGKVVRDLRCIGFTSMTEDAYSSAIIWLLKSKVYELAGDDYRVSVLWCVKKWIQAVPLQFLHALLTYLGDSVDHGSGSSGLKSPLASRPSSFPGIGVPSEALVRWHMRLEYFAYETLQDLRIGKLFEIIVDYPESSPAIEDLKLCLEYTGQHSKLVDSFISSLRYRLLTAGASTNDILHQYVSTIKALRTIDPTGVFLEAVGEPIRDYLRGRKDTIKCIVTMLTDGSGGSGSGTGNAGDNLLEELNRDAENQENADYDDHANIDEKQAWLNSESWEPDPVEADPLKGNRNRRKVDILGLMVSIIGSKDQLVNEYRVMLAEKLLNKSDFEIDSDIRTLELLKIHFGESSMQKCEIMLNDLIDSKRTNSNIKTSLLKSSQTVPGQEEAEVSHDVLDATIISSNFWPPIQIEDLVVPASVDQLLSDYAKRFHQIKTPRKLLWKKNLGTVKLELQFDGRSVQFTVAPVHAAIIMRFQEKSSWTSKALATEIGIPMDSLNRRISFWTSKGVLTESAGPDADDRTFTVVDSMSDVNKDSIVNERMAEYQMTEEEGESSVASVEEQLKKEMTVYEKYIVGMLTNFGSMSLDRIHNTLKMFCIAEPSYDKSLQQLQSFLSGLVADEKLETRDGLYLLKR

SEQ ID NO: 342 - protein, 462 aa, Zea mays
MSCLRRASRLTRGLSSSSAAEAETLPPPRPSAGRRVVVTGLGAVTPLARGVGATWDRLVAGRCAVRSLAAEDLRFPEEAAGRTLEQLPSRVVAAVPRGKGEDEFAEDTWTKDKSVSGFISYALCAADEALRDANWLPSEDDKKERTGVSIGGGIGSISDILDASQMIIENRLRRLSPYFIPKILINMASGHVSMRYGFQGPNHAAVTACATGAHSIGDATRMIQFGDADVMVAGGTESNIDALSIAGFSRLRALSTKYNSSPLLASRPFDCGRDGFVIGEGCGVMVLEALDHAKERGAKIYAEVRGYGMSGDAHHITQPQSGGRGAILAMKRALDQSGLHVNEIGYVNAHATSTPLGDAVEANAIKSVFGDHAASGDLAISSTKGAIGHLLGAAGSVEAIFTVLAIHHGLAPPTLNLERPDPLFEGAFTPLAAPKKMSIRAAISNSFGFGGTNTSLLFSCPP

SEQ ID NO: 343 - protein, 370 aa, Zea mays
MSTVFMTQLPRTLRLMEGEQDQGLFPASTFHVAKDPPILFPFMITSPVHVDQLQGQSSYGDQHLGQHVLSESTQQFTDRTMISGSEVFPRRPSPFGQTIQSIDGDMIQPSAYDPYDIVENQRTEGLSGGGWTVSSSSSSPPAKMKIMRKATSEYPEGGAARKPRRRAQAHQDESQLLTMQQQAMGVVVRVCSDCNTTKTPLWRSGPRGPKSLCNACGIRQRKARRAMVAAAAAAAASNGGAPPQAVSGVATQQQPKPKPARKEKRSDAADRSLPFKKRCKMVVVDHAAGAAAATATPEAAAARSTKDQADHVSGDKQVVAPAAAMRSLDQSEIATPPPSAVSSFHAAFPADEITDAAMLLMTLSCGLVRS

SEQ ID NO: 344 - protein, 403 aa, Zea mays
MAFLFNKFQEAIRTIAKSPMFARDPRHLQFEADVNRLFLYTSYYRLGENADEKDAEEIIDLASKASIADQQKQVQDNVHYELTHMCQAMDSILCPDTINDPSKGPSEAHNHSQRSGLSFAVGGAASANKQSAIIPATRPLTRAELSKKFRDHFGYTLDIGPSGIPHKDAGQGLFLSGQANAGAVLAIYPGVIYSPAYYRYIPGYPRIDVCNNYLITRYDGTIIDAKPWCFGGETRALWDGSDLVDYNAMAPKGSENNSDRVWRMLSKPLEKGVRENFGEVLERRNPLAFGHFANHPPKGSSPNVMICPYDFPLTEKDMRVYIPNITFGGQETIRMKRFGSFYFKSGGSDNQAGDSLVLKTLVLVSTRSICDEELFLNYRYSNSKRRPEWYSPVDEEEDKRRWS

SEQ ID NO: 345 - protein, 264 aa, Zea mays
MSSTKPHKANDSRWEAIQTARARDGILGPSHFRLLKRLGSGDIGSVYLSELSGTASYFAMKVMDKASLAGRKKLLRAQTEKEILQCLDHPFLPTLYTHLETDKFSCLVMEFCPGGDLHTLRQRQPGKHFSEQAVKFYIAEVLLALEYLHTLGIIYRDLKPENVLVREDGHIMLSDFDLSLRCAVSPTLIRSSNPDAELQKRSGRAAKATVLSQPVLSRPASLNRRVQPQPPASAHACSPPSPRPRETGNQNQKLPPRSALGLSS

SEQ ID NO: 346 - protein, 666 aa, Zea mays
MEHTYQYAWVIPLLPLPVIMSMGNLDFFLFLQQQKIFVGYGAFPSILLLSIAMVFSLHLSIQQINGSSIYQYLWSWTINNDFSLEFGYLVDPLTSIMLILITTVGILVLIYSDDYMSHDEGYLRFFVYISFFNTSMLGLVTSSNLIQIYFFWELVGMCSYLLIGFWFTRPIAASACQKAFVTNRVGDFGLLLGILGFFWITGSLEFRDLFKIANNWIPNNGINSLLTTLCAFLLFLGAVAKSAQFPLHVWLPDAMEGPTPISALIHAATMVAAGIFLLARLLPLFISLPWIMSFISLIGTITLFLGATLALAQRDIKRSLAYSTMSQLGYMMLALGIGYYQAALFHLITHAYSKALLFLGSGSVIHSMEPLVGYSPDKSQNMVLMGGLRKYVPITRTTFLCGTLSLCGIPPLACFWSKDEILSNSWLYSPFFGIIASFTAGLTAFYMFRIYLLTFDGYLRVHFQNYSSTKEGSLYSISLWGKSISKGVNRDFVLSTMKSGVSFFSQNIPKIPANTRNKIGSFSTPFGAKNTFVYPHETGNTMLFPLLILLLFTLFIGSIGIHFDNGVKDNRILELTILSKWLTPSINLFQENSNSSINSYEFLTNAISSVSLAIFGLFIAYIFYGSAYSFFQNLNFQNSLVKKNPKKSFLDEVKKRYTAGHIIVVI

SEQ ID NO: 347 - protein, 229 aa, Zea mays
MLPTSPPPIAHQPSPTSPHYLTPWMVATVPAPVPHTHQAGLADPAAANAAPSPDVSAARPPTHFRPPPAPPFARPPATSAPSATSARFSRHRPDLRAIRNRRASYPFSTAHSVWNNLRVGSLLPSPSPFPTTRFGDGELRAGATAGRFCCWCGGGGAARVVRRRLHGGGARAEFDWLALYCNLTRGDGPDGNNGKLVLEELLSCAATQFCFPQILSCEEKKKTRTRRVR

SEQ ID NO: 348 - protein, 453 aa, Zea mays
MLTAPPLAAAARRAATAAACGAAHRLLLPVCFLSSNPSAPSTLVPRRRFGHMSQECMAPRAPLPPVGRNFAVAVGDEILYGDAPELVVVSFYRFADFPDHAAFRLPLKELCEELRVSGGIILAPEGINGSICGTPVAVDKILNFIQEDGRLKGLRMIQSPVTPEDEAIHHGHTSHSPVGAGEDAPFRWDHVRVKLKKEIVTFGDPGVMPTKIVGKYVKPKDWNDLISDPDTVIIDVRNMYEIRIGKFKKAVDPRTNSFREFPTWVDDQFQLVQSGTLGSGGDDNGTGEPSADLNASKSKQLPRVAMYCTGGIRCEKASSFLLGKGFKEVYHLEGGILKYLEEIPKAESLWEGECFVFDKRVSVGHGLAQGTHKLCYGCKQPVSDEDMLSPHWEYGVSCPHCFATKSEEEKERARARQRQFETFGVIGGPHMGKSPRGSAANNAVEFIQLPKSV

SEQ ID NO: 349 - protein, 971 aa, Zea mays
MIVQPIELRAWTAFPGSAQEGIGRMAASVSRAICVQKPGSKCTRDREATSFARRSVAAPRPPHAKAAGVIRSDSGAGRGQHCSPLRAVVDAAPIQTTKKRVFHFGKGKSEGNKTMKELLGGKGANLAEMASIGLSVPPGFTVSTEACQQYQDAGCALPAGLWAEIVDGLQWVEEYMGATLGDPQRPLLLSVRSGAAVSMPGMMDTVLNLGLNDEVAAGLAAKSGERFAYDSFRRFLDMFGNVVMDIPRSLFEEKLEHMKESKGLKNDTDLTASDLKELVGQYKEVYLSAKGEPFPSDPKKQLELAVLAVFNSWESPRAKKYRSINQITGLRGTAVNVQCMVFGNMGNTSGTGVLFTRNPNTGEKKLYGEFLVNAQGEDVVAGIRTPEDLDAMKNLMPQAYDELVENCNILESHYKEMQDIEFTVQENRLWMLQCRTGKRTGKSAVKIAVDMVNEGLVEPRSAIKMVEPGHLDQLLHPQFENPSAYKDQVIATGLPASPGAAVGQVVFTAEDAEAWHSQGKAAILVRAETSPEDVGGMHAAVGILTERGGMTSHAAVVARGWGKCCVSGCSGIRVNDAEKLVTIGGHVLREGEWLSLNGSTGEVILGKQPLSPPALSGDLGTFMAWVDDVRKLKVLANADTPDDALTARNNGAQGIGLCRTEHMFFASDERIKAVRQMIMAPTLELRQQALDRLLPYQRSDFEGIFRAMDGLPVTIRLLDPPLHEFLPEGNIEDIVSELCAETGANQEDALARIEKLSEVNPMLGFRGCRLGISYPELTEMQARAIFEAAIAMTNQGVQVFPEIMVPLVGTPQELGHQVTLIRQVAEKVFANVGKTIGYKVGTMIEIPRAALVADEIAEQAEFFSFGTNDLTQMTFGYSRDDVGKFIPVYLAQGILQHDPFEVLDQRGVGELVKFATERGRKARPNLKVGICGEHGGEPSSVAFFAKAGLDYVSCSPFRVPIARLAAAQVLV

SEQ ID NO: 350 - protein, 558 aa, Zea mays
MGTPMSPWKGRLRSHHATVQSLSKRRLPSRTKNPEEKEKLRTSTKKAAPKKTARGRPAGAAQQQPMARLGLSSRHAGRDSEHPVVIDDDVNGECNGRADQSATTPLRRSPRLHVEDKSLGKSPLPPNRRETSANRKTKNAHRKYKNQESLKRNSASAALSPRKDISDVSNKKSDKHELKPNRCEVLTGKRKRGTERRLSSKKQRCQDPKLLPAVCQEIAPCNEPRKSTHRRIEKDPSIEEFEVKLKVANERLTNIDENINKLSGTEREEMGNFCGSDWTKEQDMALRKAYFSARPSPHFWKRVSKMVPGRSAEDCFNRIYNDLSTPTPIAPRPRTSKTTFSPIGNLTLSDPKLPNILEPTVGRQKTANQKSLVAQKTVRHLLQKHCRIDQAQEADHFSIFESSPSALQLNLSFEDSPGTPDSYMNSDSLGKHSGSSSARKKPFSRLRTKPSEPSPAVLKPIKNAILHEKYIDQLARREGTKRPRRRTPAGSKTADSGKSLSEQQAGSLKAAKNALISEATDFISSFKALQANSLAHVVENSEDEIECDASDCSYADKE

SEQ ID NO: 351 - protein, 319 aa, Zea mays
MMAKANGAVHASTKEPLFSFGVIADVQYADIPDGRSFLGVPRYYRHSITVLQRAVNRWNEQGNIKFSINFGDIIDGYCPKDKSLWAVQKVLDEFDKFDGPTYHMIGNHCLYNLPRSQLVSLLKIATDSDRAYYDFSPCPGFRIVVLDAYDFSCLGWPHDHPVTIAAMKLLDEKNPNTDKNSPDGLVGVDRRFVKFNGAVGKEQVSWLNDVLQDASTQHQNVIICSHLPMDPGASSPAALMWNYDEVMAIVHQYNCVKACFAGHDHKGGHSVDSHGVHHRTLEAALECPPGTSAFGHVEVYPNRLLLVGFDRMADTEVRF

SEQ ID NO: 352 - protein, 564 aa, Zea mays
MRNFIELLEASSSHRLASLSRRLTTSSAHSLLHPLLECATNSPTPPQKIRFRSTNPLPILQRSPLSDPSSPAMAAGGPALLRALLVAALCAVPWRAEAAIGVNWGTVSNHRAPPGVVVDLMRANRISKVKLFNADPGVLRALAGSGIQVMVGVTNDELASIAGSQAAADDWVAQNVSRYVGRSGVGIRYIAVGNEPFLTSYQGQFQSYIIPAMTNIQQSLVKANLASYVKLVVPCNADAYQSASVPSQGVFRTELTQLMTQLAAFLSSSGAPFVVNIYPFLSLYQNSDFPQDYAFFEGSTHPVVDGPNVYYDAFDGNFDTLVSALSKIGYGNLPIAIGEIGWPTEGAPSANLTAARAFNQGLINRITSNKGTPLRPGVPPADVYLFSLLDEEGKSILPGNFERHWGIFSFDGQAKYPLNLGLGNSVLKNAKEVPYLPSRWCVANPARDLDSVSDHMKLACSMADCTTLYYGGSCYGIGEKGNVSYAFNSYYQQQKQDPKSCDFGGLGMITYLDPSMGECRFLVGVDDSKSSAVASCGGGCCGVCCGLWVLALWVLTYLRMMGSA

SEQ ID NO: 353 - protein, 615 aa, Zea mays
MRGGGGASWLSFRGVVVEEEEAVVSAPEKPMRRGRRRWGAEVDDGYSPSSTGGGGSSCCDSFGCDSPLAGFVRPDGDPDTDLETDGLATSTSSASAAFTERQDDEAEEALYGVKEEEWAQIQEPAKNPAFRATPECHKQRYRTDAAVLLHGRKGSKQRPASLDLGSPGFHGATFSPSFVIGGVGLMNKGLGASVIRSDVFHSPGTPNYPRHRASVLGCHKGWSSERVPHPSKGNRRYPGSSMAFPYSNGRTLPSKWEDAERWIFSPNSSDALGRTTVAHARRPKSKSGPLGPPGRLGGQYSSVSSVSLLDNGRAGPITANSPFAAGVLMPEHVCEGKSTNGTYSSRPIGNEINIGRGVKICPLNGGSHPVRTSRVRQRLDYAVESSVSLPSTQESVQDEQVEITEDSASTIASIISRKDAATQTSPELSRSSSPNTRPTFNGSLSTEQVKEKGSCLSDLDIRDVQMDDRVTLTRWSKKNVTRSSNKNSTNIIEWSEKTVESKSSSWGFAKAKCISKIDREDTEITAWENIEKAKADAAIQKLVIKLEKKRSSSLDKILNTLKSAQRKSQVMHEHERDAVTANQDGKGSRKAKKRAQLSKNGQISSLSGCFTCHAF

SEQ ID NO: 354 - protein, 568 aa, Zea mays
MRSNRRRLGGRGGGWGGQGGGVSVAASFAALLGCVVALVGGAAGQGPRPPSDYKTLSGAAPLVVAKGGFSGVFPDSSQGAYSFAMITSAPDTAMWCDVQLTKDGVGVCLRDINMKNCTSVDQAYPERKRTYVIDGVRKTGWFVSDFTIAELQSVSLTQAIWPRTRRFDGIYPIISITDFRSLVMPSPVWLNVQHDIFYKQHGLDMRNYILSIKKGVSMDYISSPELGFLKNMSGRVGRKTKLVFRFLEKALLDHSINQTYGSLSSNLPFIKSIASGIIVPKSYIWPVTKDNYLLPSTSIVTEAHNAGLEIYASDFANDRIIPYNYSYDPLAEYLNFINDGGFSVDGVLSEHPITASEAIGCFTKLNSNKTDHGEPLVISHNGASGDYPDCTDLAYHSAIDDGADIIDCPIQVTNDGVLMCMSSTNLLDTTNVQRTTYNSLVSVVPDIQPQPGIFTFNLTWSDINSNVLKPKISSPVSGYFLVRNPRYTNQGKFLKLSDFLAIAMDKDLSGVMIIIEVILSLKHCIKKKTFSHRSRKPPNSCSTYTQRHHCPCKDDRNRGRTLDLRLVL

SEQ ID NO: 355 - protein, 349 aa, Zea mays
MSTSPAASAAASPPPPIASAAEASRATETLVVDERVASHVDPFLVEALDNPRHRLMVLRMELDIRNFMQNPQLQEFEFQNFPTSYLRCAAHRVAQHYGLETIVADSLVEGSVSRIVARKTPESRCPAISLAEVPSKQARNDHEAAEKLKFVIYQRPKAFQNGSTDLGNKNGAPKTVEERIEEYNKARARIFNGSVSADSDAASVLGTLCTGRDESVNVEPSVDEIKVSTMNNRSRVAVFKDTQKDRSDPDYDRNYKRYVRSPVPDFNLSPGAFNFVPQFMQYGVGYVQSPGMSTNQPAVYFGQPDLTMGSSGAAVYPHWPTPAMMYPHCYDNVGSMISQVPLYQSFNHG

SEQ ID NO: 356 - protein, 420 aa, Zea mays
MMTRRLGHSIWYWRWAPGPEIPAALKYYNPRGQATGMFASICRRRLLRLCQIPFGTGAIPSDALPHCHSLATIADAPVSEPCAALVSCGLSPAAAVAHRLPIRSTAKADAVRALLRSYGFTDAEVADLVRRLSQILSVDPDRIRPKLDLFASLGVKPRRLARYPALLTRSLDKHLVPCIQFLRNILSTDEDVCLAISRTPRALSAGLEKIMRPALDTLRRLGLPDESISKLVVIEMGVLMMSPDRICQIFEALKELGLGVTEKRFPYGIRALCCISREKWLHRVALYRSFGVSEGELQRAFKKQPNIVNFSDEIIKKKIRFFLDVLKVELSEVMEQPAIIGYSLERNIIPRCAVLSLLMREGKIGPNVKLISALLGSANMFSTRYVLRYANELPDVVKAYEGKITFDGFREQDLLVPLKL

SEQ ID NO: 357 - protein, 1016 aa, Zea mays
MEELRCLSTVAESDDAPAEQECDHFSLRGYVAMLQKKDPKLCSHIFHNQPQYDEHHDSSPVLVSKYHRWDCSRCLDSVEVSGHRPTSENVSMQQNGMNDGCSISIVRILPNSVDSRRLFSCTQQSSQGNDRLTLSKTAQECNSKCSSPGNKAITAMNVPVAEENVPEALVDTRVPSIEVLQASPNSIDLSANILNAVSKNVRDLPDDVEENGTQNPHSLKPCVAPNEDENNIANDDLNEPNVCKPVSGHKSKQVCNMGPRRASSKRNVESDDAVQVDHTNSVDLCEGGKRKMHLEVGKGNDTTNQQVDEIQSRAVKNKAKYTGVDKLEDGSSLMNWLKSTNKKVRTKKKDSEHKNLDSSSISRSYPDIVASNDMHHDFLPSVGDVGQANVPSTTSAKHGNGNAQNDKLEQNMQKMDGLCENESRNLKQRFFSNEKSTILLKRKLLSTSVVHDENIENSNIKRDMLRSDDLPQMEPEGSVQRCLAKVSLGKQKIQNVSGLHKKNIPKNKKGKQKVHKKQNVIDDFPMDIVELLARNQHERQLMTDTNSLENCHTQPKVAQVDCAAFAAKGCPTNASNEFNTNFQKSLASESKQKSLQDQASPSTEAANVNPQDLHTQKSSQCHAASSTSTEVPNGQPPESQMQNSLQVHVLPIKRSFIVYPSKLPVLDDILECTQEQQTQFHRDGGVTIACTSPMFSHHQHIAEVPARSWRNNGEKKLMWDSFKTASRNSPTSSYGFQFGNRLQEVHSSPSHAYGASSNYAAHQPVIVAVDQPRSVPSTTSTMEAGRLYDRRIPGQSGLYPKEPMPATHLLRLMDSSTAPDFTNYQRANRRQMEHQTQTLDSQYTQHDQYNGSLSTSYGRHITGKVPPTLQDLSRRQVQQNLHRPLRPHPRVGVLGSLLQQDIANWYENCGPPQSGYRLGVSKGTASLDMNRHGNYETLNSGVFTAGWNALQLGSVSSLADPEYRLPRYGTGQPCTGGNGRTVHPLDKLVRKDICVTNRNPADFTVISDMNEYMRSL

SEQ ID NO: 358 - protein, 227 aa, Zea mays
MVLFFDSGDGVSHTVPIYEGYALPHAILRLDLAGRDLTDSLMKILTERGYSFTTSAEREIVRDIKEKLAYIALDYEQELETAKNSSSVEKSYELPDGQVITIGAERFRCPEVLFQPSMIGMEAAGIHETTYNSIMKCDVDIRKDLYGNIVLSGGSTMFPGIADRMSKEITSLAPSSMKIKVVAPPERKYSVWIGGSILASLSTFQQMWISKEEYDESGPAIVHRKCF

SEQ ID NO: 359 - protein, 262 aa, Zea mays
MRAAGQVGIHALERRAAGACTVNDPVALKLLSKAGEMPSLTPPDDETIRTLYIGGLDSRITEQDLRDQFYAHGEIESIRMVLQRAIAFVTYTTREGAEKAAEELANKLVIKGVRLKLMWGKPQAPKPEEDESGRLGQVSHGGLLPRAVISQQQSGDQPQPPGMEGQQQQAAPASYYFNIPAPPATERTVYPSMDPQRMGAIVKPHDSEGKPGPQQAGQAQASSNPAQGGGYPAPPPYYHGGGQQQPPDGPPAQQQPQQPIQN

SEQ ID NO: 360 - protein, 868 aa, Zea mays
MGTGEGSPPARRGISGRRRRWPDEDDDEYVLEEEEEEDYVEELSASSAGEEGVDSDAEYQEAEEEDEIEKPRPKRPAKGITSSAGERGLDSDAEYQEAEEDDEIEPPRLKRPAKGSTSSAGEEGLDSDAEYQEAEEDEMETPRPKRPAKDSTSSAGEDGLDSDAEYQEAEEEDDDEIETPRPKRRAKGSNRVRKGKVDLAAARSRRRKYEEDEDYEEEVDEDDEVEEEYHDDLEEVEEEEEVAPQRPKSIVKCGARGRNVKLSLAAKRSHQRKQEDDEDMDFDPELDDEEVEIDEDIDFDPDVDGDEEDEYQDEEEEELVPARARKVTVKNPVKRKSISKRRTPKKKKKNRGSKVSRRKGASAKVKKSAPVRRRRKRSVIDDYEDEDVDDDDDDDFIVDDEVIVNRHPKKKARIGSGRETVVDPQVSIEEETWPDLESDSSDFEFATSDEEPNNVETPVAEQTTVRKGRKKRISESESSSDSEFVVSGKELEELREPEPPKAAPNLHVSLRRICITRHGEGKGKEKQEQEEAGKPICGICLSEELRATVQGVLNCCSHYFCFACIMEWSRVESRCPLCKQRFTTITKSSKVDLGLGVRKAVVKVEERDQVYQPTEEEIRRWLDPYENVVCIECNQGGDDNLMLLCDICDSSAHTYCVGLGREVPEGNWYCGGCRLGDEGPSYTGIQRTVAYERQNYRSHVGSSVSFGMAVPGGTFERPSSINPRHSFQGIDLNLSPREFPGESHPAESQVSTDSVSTPTGRAGRTISGRRELQRYIQSLFRPSLPSRPDTYHNIAQNSGGVSRNEPNRWNFPSSSEANTSQNLPDGIQNHHSDLPFVQAHSNFAPFMSPDGDDFQQIEGVKSNLRNMQ

SEQ ID NO: 361 - protein, 680 aa, Zea mays
MVFQKWSSSSEMESCGGGQVPEMPRVPKSARGKRSVRKKEAQSPAQMSAIDLLATVAGKLFDEGAGSLGNTSAGAPALAAFAKDALVKQEQCDEQMKLFKHEATDQDSCNESAILPHIVLQRVVNNARNEDPKAKSEVQDKESSMISYTKAELGCNFGVIADRWSPESVESGAFTGDAVARLMMTAPAGFHKNAPEMYSLLDSMDVDVKPPPLVSSDSTGEMPLHGDKIHRSTSLPRAPKGVGFFAVDRDDDDDKSSGCTHPSTATNKDFTSNCKAEYNRVRKLLTSKHRKVAPARIHKSDLSYSDVERKPSFRYKKMHTRQRTQRSTFKRRKLFDRHLALASEFGTANGKGNTKVAGRNSNAVSLEANKGTNSMPFQKSCGSNDCHVKLRIKSFNVPELLVEIPDSATVGSLKKTVLEAVTAILGGGLRVGVLHHGKKVRDDSKTLIQAGIGQDDMLDNLGFSLEPNCTQNPQVQAPEDVSFLENIDTTEPLARITPADSSSKLGEVDVSQELALTPLAMNYQGSDHDSVHSPGAVSSRDKDSRALFLVPAADPNAGAVVPANKTKRSPEQGHRRIRRPFSVAEVEALVLAVEKLGTGRWRDVKLRAFDNAKHRTYVDLKDKWKTLVHTASISPQQRRGEPVPQELLDRVLAAQAYWSQQQAKLQPKTPSLAEARLLTQ

SEQ ID NO: 362 - protein, 503 aa, Zea mays
MAYSSRTCGRCNNHERRSGFMKWLCNFLKGPKPGEPNRRRPQVTAGEEEDALWHQRPVRPKNDPPRNDNEEVDRAIAESLTEDVRTPKEKTRKGDKDDEDLARAIQDSLNMNPYTPYNPYAPSHAQPRGHRLCAGCKHEIGHGHYLSCMGIYWHPQCFRCNSCGHPIRETEFTLLSTDPYHKLCYKELHHPKCDVCLQFIPTNRSGLIEYRAHPFWGQKYCPSHEHDRTPRCCSCEKMEPRNTKYMSLGDGRSLCMECLGSAVMDTGECQPLYHSIRDYYEGMNMKLDQQIPMLLVERQALNEAMEGESRGPHHMPETRGLCLSEEQTVSSILRRPRIGGNRLLDMRTQPQKLTRRCEVTAILVLYGLPRLLTGSILAHELMHGWLRLKGYRNLNAEVEEGICQVMSYLWLESEILPSSSRHAQPSSSYASSSSSSYSYPPTSSKKGGISHTEKKLGEFFMHQIAHDTSTAYGDGFRTAYAAVNKYGLRQTLNHIRLTGGLAV

SEQ ID NO: 363 - protein, 915 aa, Zea mays
MDPPPRRLAAPLLLLLLAAASPAARAWKKDEFRNCNQTPFCKRARTRAPHSLEAPLSLAAGSLAVSPDGSISAELSHPSRPRPLVLRLSVLPPHALRLQIDEDYSTATPPHRRFQVPDVLLPDLEARTLHLPEPKTAAGVSTVALSSDLDVVVKHDPFELTLRRAGSGDPVLSFNSHGLFDFEPMRESKPENETWEEHFRSHTDKRPRGPQSITFDLSFYGADFVYGLPEHGSTSLALRPTRGPGVEESEPYRLFNLDVFEYLHESPFGLYGSIPFMIGHGSRSSSGFFWLNAAEMQIDVLAPGWDGATAQDNGRIDTLWMAEAGVVDAFFFVGSEPKDVIKQYISVSGTPSMPQQFAIAYHQCRWNYRDEADVDSVDAGFDEHDIPYDVLWLDIEHTDGKRYFTWDHSAFPNPEEMQRKIADKGRKMVTIVDPHIKRDSSFHLHQEATDKGYYVKDANGNDYDGWCWPGSSSYPDMLNPEIREWWADKFSYENYKGSTPTLYIWNDMNEPSVFNGPEVTMPRDAMHYGDVEHRELHNAYGYYFHMATADGLLKRDKGKHRPFVLSRAFFAGSQRYGAVWTGDNSADWDHLKSSIPMVLILGLTGLPFSGADVGGFFGNPEPDLLVRWYQVGAFYPFFRGHAHHDTKRREPWLFGERRTAIIREAIHMRYSLLPYFYTLFREASVNGIPVMRPLWLEFPEDKETYNNGEAFMVGPSLLAQGIYEEGQKSVSVYLPGKESWYDLRNGSPYKGSVTHKLQVLEDSIPSFQRAGTIVPRKDRFRRSSTQMVNDPYTLVIALNSSGAAEGELYMDDGKSYDYQQGAFSHRRFVFADNKLTSFNIAPDNLSKKFTSGCVIERIIVLGLRSGVKKAIIEPGNQEVEIESGPISLRSGSSPVVPTIRRPNVRIADSWTIWIA

SEQ ID NO: 364 - protein, 547 aa, Zea mays
MELATVAAAVASAAARPHGPFSSPRAVSASVSWTSLSLAYTSRCLSSTSSRRRLRWLPVTSAAVELREATAGGGDSLRVTKTPQPGSSVKFSVEVPTSIIHECYQSTLQEYAKRVKVPGFRPGKTIPENVLINYVGPQHVQDATIEAILKHTLPQALSSVEERALEDSVRILTQFDDMRNSFSLDNVFRYDVAVDVAPEVRWLSEDKYRNLKVVVEIDEAVDAEKAAEKELQRRHKALGLLRIVADRGLQIGDLVVLDIFAESINNDGSRGEKISSAESTGFHLDTEENSNLVPGFLGSLIGIRAGETRSFPIQFPESFERESLRGVRAQFTVVCKELFYRELPVMDDSLAVKLLPGCTTIDEVRERILKRCKEVEKTAIEQATDNAILDQLGKLVEVDVPRALFQEQGQQLYGAKLLQLQAERKLDKDQLASLSTKRSVQAYLEDEKENITRIIKQMLAVGDIFKSENLQYSTDQLVKEVENSIAEFKQYNQDYDEDNIRQQVWLFLVVTSSTKLQPSSVLTLMRMYFYARFNDAGPGCPRGGEGA

SEQ ID NO: 365 - protein, 314 aa, Zea mays
MAADSSMGFHQGITASLYNHHMLSFQSNSDVGIGGGDDATGGMVMAPGSVSGGSGNAGLFLSPNTGVVGNAPGVAPLMNSSGDAFRGTGTPKYKYVTGSPSDWSDREVDILNEGLVRYAREPSIMRYIKIAAMLPNRTIRDVALRCCWATQGKERRKKPDGFYTGKKMRDVKPIQDKMVASVPIANFHMTPTTNVIPFSVSTQHPNQQSQVPKEAPVVDSATQRLLEENNQLLNQISANNETFKTVENTDLFLRTSNNIKTILSRMSETPGIMSQMPPLPLSINEDHINSLIQLNRLVASYGTTSISHHTKQEP

SEQ ID NO: 366 - protein, 303 aa, Zea mays
MREILHIQGGQCGNQIGAKFWEVICDEHGIDHTGKYAGDSDLQLERINVYYNEASGGRFVPRAVLMDLEPGTMDSVRSGPFGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLATPTFGDLNHLISATMSGVTCCLRFPGQLNSDLRKLAVNPDPLPTSALLHGWICSTDLAGLPAVPRSHRARADPADVGLQEHDVCC

SEQ ID NO: 367 - protein, 88 aa, Zea mays
MICLASWINKQVASILEDDKKGVLRPPSDSTKHGRAGLLEILERKNVRFVPFSGWEKINSVEKMAGELRNKPREKITTWDGLQKVAHE

SEQ ID NO: 368 - protein, 853 aa, Zea mays
MGKRSGSSRKDKNKVILPPELPPEIHDDEVDVSEEDIEFYATDSSNVTPFRHFDKKSIDRYVGRVAGRDEGEVERLYEERQKRKATESSGRPREDDDYLEVDPVDALPTKTLQGELVYNRAKKARSEDNSGSVKTKAQENGANAKTNTKKDESKGKSKNKKGDDNKVKNIQSQTEVPKGQLHSNVLEEVKEELSAEELFEKKKAQLAELGMSMLEDPESNIRSLNDMLSISNDRDQKVVKLGVMSLLAVFKDVIPSYRIRQLTEKELAVEVSKEVKKTRYYEYTLIRCYKAYLQKLISLEKQPYFYTVAVRCMCALLDTAPHFNFRESLLASVVKNLSSSDDVVRKMCCEAIRSLFINEGKHRGEATIEAVRLIADHVKLNDCQLHPDSIEVFLSLRFDEDIGKDEIQEEKVKPKRNKRWQKNQEVPKQLPVNDKKKTRQELISKARKEVDADLRAVSFTLDPKERKGIQKETLSALFETYFRILKHSMAASNSRTKVNNVSPGGSHPLLTPCLEGLGKFSHLIDLDFMGELISCLKKLSGYSDRQDEIPNDNALSVSERLQCCIVVFKVWRSNLEALNVDLQDFFVQLYNLILEYRPDRDHGEVLADALKTLLWEGRQHDMLRAAAFIKRLATFALSFGSAEAIAALVTLKHLLQKNSKCRNMLENDSGGGSLSCLVAKYNPEATDPYLSGALASVLWELSLLEKHYDISVSSMASNILSMANLNPTQNPVPILNVNPLEAYRDLSLERELSKPASKALPLNLKRKRRAKEFVALSPDVLQKADCSVDKDELEEKLQSHFSVLRGISENERLRAELNHTLSSINMYKEYKKQKRKNMKVKTGRKKNSKALAV

SEQ ID NO: 369 - protein, 1640 aa, Zea mays
MHGWRGAEGCDVRRRRLVRLMWPAARVEAEAPPPPAQGPATSPSGSSATHPRTTYRPESSAQKQECIDLPCPVSSDSFVKDGREIRVGDCALFRAVDVPPFIGLIRWIEKKEEGYPKLRVSWLYRPNDVKLNKGIQLNAAPNEIFYSFHQDEASAVSLLHPCKVAFLRKGVELPAGIASFVCWRVYDIDNKCLWWLTDRDYINERQEEVNRLLYRTRLEMRAALQSGGRSPKRLNSPSASQQLKTASDGTQNGGLSRGKKRERSEQGVDPAKRDRDRLLKVDDGEPGSFNLDDIKSEIAKITEKGGLPNAEAVAKLVHLMQLDRTEQKIDHSGRVILADVIAATDSPDCLGRFVQSRGLPVLDSWLQEAHKGKSGDGSSPKEADKPIDELLLALLRALAKLPINLSALQSCSIGKSVNHLRSHKNLEIQKKAKCLVENWKKRVDAEMKSNDVKPLVSGQSVSWSGKAGFQEISNVGTKRGGSSENSPKNSVPTLSSSKVLTDKPGGTDAAAKLNPGVSALSNLQHVQSTHVTTNLKEQPCKSTGGTGCPELPTVKEEKSSSSSQSPNNSQSISSEPSKDARSSTAASGGASKTSGSSSRSHRRANNGLVSGNLKEPSVGRSVSLDRSLLQDKSSQTGTASEKGIDMPSDHGNNHRLIVRFPNPGRSPARSASAGSFDDPSVTGGRASSPVVADRHDQTERRVKVKTENSRPHLASDANAESWHSNDIKGATGSEEGDKSPCAILDDDNSRTPDHSVKDAHASRAACSSYMNEKGVSETKVGTSFSPMNALIEIKYSEASHSLQAGDDTAMNLLASVAGEISKSELASSPSTSVKKLVCEGVNTGKVKVESDMGPSHPGQADAKKVAMGNEVKNDACLVPKEEQHQTAPSPELADSKAVKSSAKIEIHEGHANKCNSQHASIDSKGEHDQNFNLCHSANTNVVNISNMYSSAGENRDGCTAHGKVEDGSTNKDGAMESAFGSQRSLVVSSKNSRLVLAGESSLSAADKQTQGLLKSTNHKHLLSVSDNPGAFDRHDSMAGKLDLMAAEVKKADVVGNSSVLQNDTEKKEHVSPSSADVPKLVPAASPVGVANGNNEMKESNGSSSESNSHVKSEGVNSQQSEQSAKQSSKKSSDGVCGKEDHVLSDEEGSSLAAHTKSNATAKLDFDLNEGIPGDDGHQSETTASPVVCSSAIHLTGLLPFTSPTTSGLPPAPITVAAPAKGPFVPPENLLRAKPEIGWKGSAATSAFRPAEPRKILEMPAATRDIPVSHAAGKQSRPTLGFDLNVADDQALEEDFPQSSAQTTCSESGNTRSRDGSSRSAGIELDLNRADEVADNGQFVPNASHRVEVPLFSTRSLPRVLSNAGANSSRDFDLNSGPDLYDVGTEPAPRSLPSKNTSSIQFLPQVPVRMNSDAMSNNISPWLVSTSPCGPVAIQSFLPSREQPYPLEAAPGAQRIIAPTADGGQFGGDPCRPPVISTSPAMVFHPPAYQYAGFSFPPSVHLQTPAFSIGSATFNNSASAGVPYFPTLSSSLVGPAGALPSQHSRQYAINLAEGSSSSVRDGNRKWESQGLDLNSGPGSIDLEGKDERMPLPVRQNLIPPLHGFVEDQGRIYQMPVVGTKRKEPDGSWDSERSTYKQLPWQ

SEQ ID NO: 370 - protein, 1924 aa, Zea mays
MASSTSRRRRGGGLERVADNWERLVRAALKRDRDHLRVGGAPAAVGGQRLADAVPASLGRTTNIEQILQAADDIEVEDPNVARILCEQAYTMAQNLDPSSEGRGVLQFKTGLASVIKQKLAKKDGAPIDRQNDVQVLWNFYLEYKSRCRVDDMQREQERLRESGTFSTEMGNRAMKMKKVFATLRALLDVLENLVGQSPTDRLHRQILEEIKRIKRSDAALRGELMPYNIVPLDTSSSVANIFGFFPEVIAATAAIQNCEDLPRFPFDTPQLRQKDIFDLLQYVFGFQEDNIRNQRENVVLMLANAQSRLSLQIGSEPKIDEMAVTDVFCKVLDNYIKWCRYLGRRVAWTSLEAVNKNRKIILVALYFLIWGEAANIRFLPECICYIFHNMAKELDGILDSSVAETAKSCTTEGSTSFLEKIITPIYDTMAAEAENNKDGKAAHSAWRNYDDFNEYFWSRSCFELGWPPAEGSKFLRKPAKRKRTGKTNFVEHRTFLHLYRSFHRLWIFLLLMFQLLAIIAFHHGKMDIDTIRILLSAGPAFFVLNFIECCLDVILMFGAYKTARGFAISRLVIRFLWLTAVSTFVTYLYVKVLEERDTRNSDSTYFRIYGLVLGGYAAVRIMFALMAKIPACHRLSSFSDRSQFFQFFKWIYQERYYVGRGLYESISDYARYVIFWVVILACKFTFAYFLQIRPLVEPTNIIVQLHDLKYSWHDLVSRGNKNALTILSLWAPVLAIYLMDIHIWYTLLSALVGGVMGARDRLGEIRSIEMLHKRFESFPEAFAKNLSASRFLTLFSIFESEITTKTYASIFSPFWNEIIKSLREEDYISNRLLGEFLSREMDLLMMPSNCGNLMLVQWPLFLLTSKIMLANDYASDCKDSQYELWDRISKDEYMAYAVKECYYSTEKILHSLVDAEGQHWVVRLFRDLNDSIAQGSLLVTINLKKLQLVQSRLTGLTGLLIRDETAGRAAGVTKALLELYEVVTHEFLSQNLREQFDTWQLLLRARNDGRLFSKILWPKDPEMKEQLKRLHLLLTVKDSATNIPKNLEARRRLQFFTNSLFMDIPQAKPVSEMIPFSVFTPYYSETVLYSMSELCVENEDGISILFYLQKIYPDEWANFLERIGCGESSEDDFKESPSDTMELRFWVSYRGQTLARTVRGMMYYRRALMLQSYLERRCLGGIEDGNSAAEYIDTQGYELSPDARAQADIKFTYVVSCQIYGLQKQTKKQEAADIALLLQRNEALRVAFIHEEEIISRDGKATTREYYSKLVKADVHGKDQEIYCIKLPGNPKLGEGKPENQNHAIIFTRGDAVQTIDMNQDNYLEEAMKMRNLLEEFHNAHGKHGIRKPTILGVREHVFTGSVSSLASFMSKQETSFVTLGQRVLAYLKVRMHYGHPDVFDRIFHITRGGISKASRVINISEDIYAGFNSTLRQGNITHHEYIQVGKGRDVGLNQIALFEGKVAGGNGEQVLSRDVYRLGQLFDFFRMLTFFFTTVGYYVCTMMTVLTVYIFLYGRVYLALSGLDYSISRQARFLGNTALDAALNAQFLVQIGIFTAVPMIMGFILELGLMKAVFSFITMQLQFCSVFFTFSLGTRTHYFGRTILHGGAKYRATGRGFVVRHIKFAENYRLYSRSHFVKALEVALLLIVYIAYGYTKGGSSSFILITISSWFLVMSWLFAPYIFNPSGFEWQKTVEDFDDWTNWLLYKGGVGVKGDNSWESWWDEEQAHIQTFRGRILETILSLRFLMFQYGIVYKLKITDHNTSLAVYGFSWIVLFVMVLLFKLFTATPRKSTALPTFVRFLQGVLAIGIIAGIALLIVLTSFTVADLFASALAFIATGWCVLCLAVTWKRVVKVLGLWDSVREIARMYDAGMGAIIFVPIVVFSWFPFVSTFQSRFLFNQAFSRGLEISLILAGNKANQQI

SEQ ID NO: 371 - protein, 286 aa, Zea mays
MEEYLESMKSLRSYMNDLEDDAAKRSVEEQQQRTAIDAHDSDVALVMAQAKQASEEAERLATARAKVGMQMAEKQGRIATLDIECATLKQTLELLRQETASTFVKLCEKRLFYTKRTETLTVKLQEQQEWFSMKNKITRQEPHVAKSQSKQNFIEGEKHVIFNSEGSLDKFNKPGKLYTQLVSAQLKIQDIKSQRSALLLEISRIKQILEQEKNIIPGFPAALQQMDMKSLEEEYKALQGDKSGEVEYFQSLDETINGMKGILDPVKCQCGLEYNLKLDGEAMDIS

SEQ ID NO: 372 - protein, 435 aa, Zea mays
MGLSTVYSPAGPRLVPAPLGRCRSAQPRRPRRAPLATVRCSVDATKQAQDGVATAVATEAPASRKECFGVFCTTYDLKAEDKTKSWKKLVNVAVSGAAGMISNHLLFKLASGEVFGQDQPIALKLLGSERSFQALEGVAMELEDSLYPLLREVSIGIDPYVVFQDVDWALLIGAKPRGPGMERAALLDINGQIFADQGKALNAVASRNAKVLVVGNPCNTNALICLKNAPNIPAKNFHALTRLDENRAKCQLALKAGVFYDKVSNVTIWGNHSTTQVPDFLNAKIDGRPVKEVIKDTKWLEEEFTLTVQKVCASPCLQYVWCCLSLEKLSQDCTIIYSVHISKQRGGVLIQKWGRSSAASTAVSIVDAIRSLVTPTPEGDWFSTGVSFEAFEPIKSLFRHSSNGKGDKKNTGLYDWKSLWHSRGYRVQHAMQIEG

SEQ ID NO: 373 - protein, 193 aa, Zea mays
MATDEATKPSPIPPYPEMILAAIEGLDDKSGSNKSAISKYIEGKYGSLPPAHASLLTAHLARMKESGELVFLKNNYFRAGAPDAPPKRGRGRPPKARDPNAPAPAPKSPSSTGRGRGRPPKAKSPLEAAVKQATAGMPKPRGRPPKKAKTDGAASPSPSPAPAPAGDGSTPGKRGRGRPPKVRPAVPSETAAA

SEQ ID NO: 374 - protein, 151 aa, Zea mays
MSETAGQSLHHSCSRYTIRAGRYLCDKEFRYVRTVRVTAAVYRGFHSKLITLLLPTFQHRAGVRLYTSCYHLAESCVFNKQSLPPGMCRFPNQKIGEHPFSRSYGVILPSSFDMVLSTRPSILYLFTCVGLGYGQFTGRIALPIRSFFLEV

SEQ ID NO: 375 - protein, 1003 aa, Zea mays
MAIPEDLEGTSGDGGVTNRGSRGRRKGAAKGRGRGRPRSADRSFPPPAMAGVAVGDRVLRERRHTTNVFCERDTDVDDESIYFQDDVETVRSKDSRSGDVLQTAKKRKKGGAGKVSVTKRSKREGEEQKKASPSKDKDCAETNGKRKMLTGDNALMCHQCQRNDKGRVVWCNSCRNKRFCVPCIERWYPNLSEDEFAAKCPYCRKNCNCKGCLRMRGVEEPPKKEISEENQISYACNVVRLLLPWLRKLRQEQMEEKKLEAKIKGVLVNEMKLEQAEYNLDERVYCNNCKTSIVDFHRSCKYCFYDLCLDCCVEIRRGEIPGGEEIMRVKPEDRGRAYLFGTTNSKDGSKRFSMRRHSSSLENEPSNVVGSSEGANNSLELWKAESDGSIPCPPKELGGCGGSILDLKCFFPEKMLSNLEERADRIMRSEVFAKAVAKRSDQCPCYDHSGNIRTQDVRETANTKGSSDNHLYCPVATAIKEDDLAHFQMHWTKGEPVIVSDVLHLTSGLSWEPLVMWRALREKKTNGDVEDEHFAVRALDCLDWCEVEINIHMFFVGYMKGRTHHMTHWPEMLKLKDWPPSSSFDQRLPRHGAEFISALPFPEYTDPRYGPLNLTVKLPDGALKPDLGPKTYIAYGFYQELGRGDSVTKLHCDMSDAVNILTHTAQVPYARYQLEKIEETRKKMKEQDLQELYGVSELNLSSPFTDSRNISADEMSKTSCNYGLDVNDVPPVNNESEVQSGAGQCSDYIDKDRSYAGMHNGERTGGALWDIFRREDSDKIQDYLRKHATEFRHIFCNPVKQVIHPIHDQTFYLTEEHKRKLKEEYGVEPWTFEQKLGEAVFIPAGCPHQVRNLKSCIKVAMDFVSPESVNECMKLTGEFRRLPPDHRAKEDKLEIKKIALHALNQVVNFLDPSSEWSKSWFAQLKNKKKAGAEEQEKPKRKRGRPCRKSNDEAAGDRHRKKGGRQRGRKRGYGKSKDGAGAVDVKPPKRQRNLLKGSGNRVGG

SEQ ID NO: 376 - protein, 611 aa, Zea mays
MATMESLIGLVNRIQRACTVLGDHGGGGGEGSLWEALPSVAVVGGQSSGKSSVLESIVGRDFLPRGSGIVTRRPLVLQLHKTDGGHEYAEFLHAPRKRFTDFAAVRKEIADETDRITGKTKAISNVPIHLSIYSPHVVNLTLIDLPGLTKVAVEGQPESIVQDIENMVRAYVDKPNCIILAISPANQDIATSDAIKLARDVDPSGDRTFGVLTKLDLMDKGTNAVDVLEGRQYRLQHPWVGIVNRSQADINKNVDMLSARRKEKEYFESSPEYGHLAHKMGAEYLAKLLSQHLEAVIRAKIPSIIAMINKTIDEIEAQLDRLGRPIGGDAGAQLYTILDMCRAFDRVFKEHLDGGRPGGDRIYGVFDNQLPAALKKLPFDRHLSMQNVRKVISEADGYQPHLIAPEQGYRRLIDSSLSYFKGPAEASVDAVHLVLKELVRRSIAATEELKRFPTLQSDIAAAANDSLERFREDGRKTVLRLVEMEASYLTVEFFRKLPTEPEKAADKNTPVSDRYQDNHLRRIGSNVSSYINMVCETLRNTVPKAIVHCQVKEAKRNLLNRFYAHVGSKEKKQLSAMLDEDPALMEKRDALVKRLELYKSARNEIDSVAWK

SEQ ID NO: 377 - protein, 452 aa, Zea mays
MREECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVFNAVGGGTGSGLGSLLLERLSVDYGKKSKLGFTVYPSPQVSTSVVEPYNSVLSTHSLLEHTDVAILLDNEAIYDICRRSLDIERPTYTNLNRLVSQVISSLTASLRFDGALNVDVNEFQTNLVPYPRIHFMLSSYAPVISAEKAYHEQLSVAEITNSAFEPSSMMAKCDPRHGKYMACCLMYRGDVVPKDVNAAVATIKTKRTIQFVDWCPTGFKCGINYQPPSVVPGGDLAKVQRAVCMISNSTSVVEVFSRIDHKFDLMYAKRAFVHWYVGEGMEEGEFSEAREDLAALEKDYEEVGAEFDEGEDGDEGDEY

SEQ ID NO: 378 - protein, 1076 aa, Zea mays
MDGGDATNSGKHVAGQVCQICGDGVGTAADGDLFTACDVCGFPVCRPCYEYERKDGTQACPQCKTKYKRHKGSPPVHGEENEDVDADDVSDYNYQASGNQDQKQKIAERMLTWRTNSRGSDIGLAKYDSGEIGHGKYDSGEIPRGYIPSLTHSQISGEIPGASPDHMMSPVGNIGRRGHQFPYVNHSPNPSREFSGSLGNVAWKERVDGWKMKDKGAIPMTNGTSIAPSEGRGVADIDASTDYNMEDALLNDETRQPLSRKVPIPSSRINPYRMVIVLRLAVLCIFLRYRITHPVNNAYPLWLLSVICEIWFALSWILDQFPKWSPINRETYLDRLALRYDREGEPSQLAPVDIFVSTVDPMKEPPLVTANTVLSILAVDYPVDKVSCYVSDDGAAMLTFDALSETSEFARKWVPFCKKYNIEPRAPEWYFAQKIDYLKDKVQTSFVKERRAMKREYEEFKVRINGLVANAQKVPEEGWIMQDGTPWPGNNTRDHPGMIQVFLGHSGGLDVEGNELPRLVYVSREKRPGFQHHKKAGAMNALVRVSAVLTNGQYMLNLDCDHYINNSKALREAMCFLMDPNLGRNVCYVQFPQRFDGIDRNDRYANRNTVFFDINLRGLDGIQGPVYVGTGCVFNRTALYGYEPPVKKKKPGFFSSLCGGRKKTSKSKKSSEKKKSHRHADSSVPVFNLEDIEEGIEGSQFDDEKSLIMSQMSLEKRFGQSSVFVASTLMEYGGVPQSATPESLLKEAIHVISCGYEDKTDWGTEIGWIYGSVTEDILTGFKMHARGWRSIYCMPKRPAFKGSAPINLSDRLNQVLRWALGSIEILFSRHCPIWYGYGGRLKFLERFAYINTTIYPLTSIPLLLYCILPAVCLLTGKFIIPKISNLESVWFISLFISIFATGILEMRWSGVGIDEWWRNEQFWVIGGISAHLFAVFQGLLKVLAGIDTSFTVTSKATDEEGDFAELYMFKWTTLLIPPTTILIINLVGVVAGISYAINSGYQSWGPLFGKLFFAFWVIVHLYPFLKGLMGKQNRTPTIVVVWAILLASIFSLMWVRIDPFTTRVTGPDIAKCGINC

SEQ ID NO: 379 - protein, 163 aa, Zea mays
MDSSVEKQGSVALDPDERAPASGETKACTECHTTKTPLWRGGPCGPMSLCNACGIRYRKKRREAMGLESSSKAATAGGSEHQQQQRKKKATAAAAAASSKRERERERERNKEADEVTVELRAVGFGKEVVLKQRRRMRRRRRLGEEERAAILLMALSSGVVYA

SEQ ID NO: 380 - protein, 380 aa, Zea mays
MDSMEDAVSGTAAQGDLAEVVARAGAMAAAASHHHHRRPPSPAAADHGHIVSAARATARSQIMLVPAAACYDDETRPAAACGDAVMFDAPSSSMAAAVGPYHHLSSSSAALAPAHGGYWLPPQQISQEHARDGGLDEPPVVTRISPVTTPPPPSHHHQIMNRKNEVKKVVCIPALPPPASSRPGGGEVIPSDLWAWRKYGQKPIKGSPYPRGYYRCSSSKGCMARKQVERSRSDPNMLVITYTAEHNHPWPMQRNVLAGYSRPHTATHMSSNCKKKKNSCSVEPTSSWPTTTTSSPSSKNGNYECQQMTNMTMEENAAAGYVAYAIDDEECAAMHQPINCGSVQPSADEVFAELEELEPTTSPVNANIFSRGVTYEWHKF

SEQ ID NO: 381 - protein, 719 aa, Zea mays
MAPPALDSLPAPLRSLRLKTKQQELLLRVSALALIYVLAFAVRLFSVLRYESMIHEFDPYFNYRTTLFLTENGFSEFWNWFDFESWYPLGRVVGGTLYPGLMVTAALLHRLLRALYLTVHIREVCVLTAPFFAANTTLVAYAFGREIWDSGAGLVAAALIAIVPGYISRSVAGSYDNEGVAIFALLLTFYLFVRAVNTGSLAWALASAFGYFYMVSAWGGYVFIINLVPLYVLVLLVTGRYSQRLYVAYNCMYVLGMLLAMQIRFVGFQHVQSGEHMAAMGVFFLLQVFFFLDWVKYLLNDARLFKSFLRITLTCVITIGTLALGLGTASGYISPWTGRFYSLLDPTYAKDHIPIIASVSEHQPTAWSSFMFDFHILLFLFPAGLYFCFKRLSDATIFIVMYGLTTMYFAGVMVRLILVAAPAVCLISAIAASATIKNLTTLIRTKSKSPQTTGKTTGSKAGAKGAVDQSLPFQHNAAIALLLGAFYLLSRYAIHCTWVTSEAYSSPSIVLAARGHNGGRVIFDDYREAYYWLRQNTPPDAKIMSWWDYGYQITAMGNRTVIVDNNTWNNTHIATVGRAMSSYEDEAYEIMQSLDVNYVLVVFGGVTGYSSDDINKFLWMVRIGGGVFPVIKEPDYLVNGEYRIDKGAAPKMLNCLMYKLCYYRFGELTTEYGKPPGYDRVRGVEIGNKDIKLEYLEEAFTTSNWIVRIYKVKPPKNRS

SEQ ID NO: 382 - protein, 706 aa, Zea mays
MSEPAQPSGGEGDVNTLRILVATDCHLGYMEKDEIRRFDSFQAFEEICALADKNKVDFILLGGDLFHENKPSRSTLVKTIEILRRYCLNDQPVKFQVVSDQTVNFPNRFGKVNYEDPNFNVGLPVFTIHGNHDDPAGVDNLSAIDILSACNLVNYFGKMDLGGSGVGQIAVYPVLVKKGMTSVALYGLGNIRDERLNRMFQTPHSVQWMRPGTQDGESASDWFNILVLHQNRIKTNPKSAINEHFLPRFLDFIVWGHEHECLIDPQEVPGMGFHITQPGSSVATSLIDGEAKPKHVLLLEIKGNQYRPTKIPLRSVRPFEYAEVVLKDEADVNSNDQDSVLEHLDKIVRNLIEKSSQPTASRSEPKLPLVRIKVDYSGFSTINPQRFGQKYVGKVANPQDILIFSKSAKKRQTTGDHIDDSEKLRPEELNQQTIEALVAESNLKMEILPVDDLDIALHDFVNKDDKMAFYSCLQRNLEETRNKLSSEADKSKFEEEDIIVKVGECMQERVKERSLHSKDGTRLTTGSHNLDTGGKSFTAQSNQNSFSDDEDTREMLLGARSTDVGRKSSGFTRPSKDTADVAKRGTSKRGRGRGTSSMKQTTLSFSQSRSATVIRSEDVASSEEEADANEVVENSEEESAQQVGRKRAAPRGRGRGRGGGSTAKRGRKTDIASMQNMMSKDDDDSEDEPPKKTPRVTRNYGAVRRR

SEQ ID NO: 383 - protein, 1178 aa, Zea mays
MEPGLSIESGSAIRVAVLPVGGPIPPPRLREYAALVARHARVDLASLRTYYAEHQKSPFQHQPWETGCLRLKFVLGGCVPSPWEDFQSSRKVLAVIGICHLPSSPDLDHVAADFIDAARSYPSALANRCFAFCPTDAQLSAKKRDDIIMFPPSDQQSLELHMLTMIQDLAASLLMEFEKWVLRAESTGTILKTPLDSQSSLGSEEVIKAKKRRLGRAQKIIGDYCLLAGSPVDANAHYTTAIELARLTGDVFWHAGALEGSVCALVVDRMGQSDPILEDEVKYRYYTIIQLYRRATLQDNAQRVSPVSFELEAALKLARYLCRRELAKEVSDLLMGAADGAKALIDASDRLILYIEIARLFGTLGYKRKAAFFSRQVAQLYLQQDNAYAAMSAMQVLTMTTNAYHVQSRKTMKMNHDPSKEPRAGNTDSGKVHPQSIVSLFESQWSTLQMVVLREILISSIRAADPLSSWSAAARLLRSFYPLITPAGQSGLASSLANAADKLPTGTRCADPCLPFIRLHSFPLHPSQRDIVKRNPHKKEWWAGAGPSGPFIYTPFSKAGASGTSKQELSWIVGEPVQVMVELANPCSFDIVVESIYLSVHSGNFDAFPVSVSLPPNTSKLVLLSGIPTKVGQISIPGCIVHCFGVITEHLFKEVDCLLLGAAQGLVLSDPFRCCGSSKFKSVNFPSISVVPPLPLLIANVVGGDGSILLYEGEIRDVLITLTNAGTVPVEEANVALSGKNQDSVISIAHSTWKSALPIKPGGEVTFAVTLRAWHLSSADLEADGSRSPVNSRRIAREGTNPFLDIHYAGPAANLENGDVSLLPGRRLVVPLNICVVQGMRLVRARLLSMEIPARFTETHLKPVSGKDINLLKVDPYKGSWGLRLLELELFNPTDVVFYVDVAVHLDDTDVDQEVISDGDAACHKTRIDRDYSARVLIPLENFKLPVLDASFFVKASSSDEPLGSRAAAIAERNAKAELNASINNLISKIKVKWHSGRNSSGELNIKDAIQTALQASIMDILLPDPLMFSFKLVTNGTVVNVDSPKDSGNVLRCKDPISAHEMTHMEVQIRNNTKEIIRMNLSISCKDVAGENCFDENSATVLWAGVLSDIHLEVPPLQEVVHPFSMYFLVPGDYSLQAASVIIDATDVLRARAKAESPDEPILCRGSPFHIRVVGTA

SEQ ID NO: 384 - protein, 154 aa, Zea mays
MASKVELVVEVKSPADKLWAALRDSTELFPKIFPEQYKSIETVEGDGKSAGTVRLLKYTEAVPMLTFAKEKLETADDENKVVSYSVVDGELADFYKNFKITLKVTPAKAEGEGGAVVSWAMEFDKANDQVPDPDVIKETATKTFHDLDDYLLKN

SEQ ID NO: 385 - protein, 454 aa, Zea mays
MIFLLTDRKMLLSSSKPFMIATCGMPGIPLNRESESVEDVHRVLRALPLFREMEGILRERNLNLPSVQEISAFRVNLFSGIRRESAIADYDAFWRSLLEEIHTPQGRSCFGQRIQDLHARMSAEGNWDYLIAQQGRGYFGNLPNLNSPLDQYQFGIHPILDLNIGEYYVSFTNLSLSMLLTLGLVLLLVLPMILRSLECRFLTIALCDAAEPWQLGSQDAATPMMQGIIDLHHDIFFFLILILVFVSRMLVRALWHFNEQTNPIPQRIVHGTTIEIIRTIFPSVIPLFIAIPSFALLYSMDGVLVDPAITIKAIGHQWRASTQPYEYSDYNSSDEQSLTFDSYTIPEDDPELGQSCLLEVDNRVVVPAKTHLRMIVTPANVPHSWVVPSSGVKCDAVPGRSNLTSISVQREGVYYGQCSEICGTNHAFTPIVVEAVTLKDYADWVSNQLILQTN

SEQ ID NO: 386 - protein, 73 aa, Zea mays
MIEVVLNDRLGKKVRVKCNEDDTIGDLKKLVAAQTGTRPEKIRIQKWYNIYKDHITLKDYEIHDGMGLELYYN

SEQ ID NO: 387 - protein, 572 aa, Zea mays
MASTSVPELTADKKCDKAIADTAAPLTSQGHSEEPTGKVSTLVPALPVVIAAGDGAASSGVIENRNGMDNSADGSLKRDDSEGAEKSSLRGSVKDSSVSAKCSDRASSLSKASGSAKISGQPADMIESGKSSLYRASGGSDLSDESTCSSICSSVSKPHKSNDSKWEAIQVVRTKEGSVGLGHFRLLKRLGCGDIGSVYLSELSGTKCYFAMKIMDKASLATRKKLLRAQTEREILQCLDHPFLPTLYTHFETDKFSCLVMEFCPGGDLHTLRQKQPGKYFPEQAAKFYVAEVLLALEYLHMLGIIYRDLKPENVLVREDGHIMLSDFDLSLRCAVSPTLLRSSNPSGDNQKGNPAYCVQPVCIEPACMQPSCVTTTTCFSPRFFSSKSKEKKDKKAKADLANQVRPLPELVAEPTDARSMSFVGTHEYLAPEIIKGEGHGSAVDWWTFGIFLYELLFGKTPFKGSGNRATLFNVVGQPLRFPESPVVSFAARDLIRGLLIKEPQHRLAYKRGATEIKQHPFFEGVNWALIRCATPPDIPKPVEIPRSVASSSQKATSAAEKGSDYLELEFF

SEQ ID NO: 388 - protein, 260 aa, Zea mays
MALVSASSSSTTAVTALPRNGQRASSSFLGGKTLLRQAEAARPSFAVRAAADPNRPIWFPGSTPPPWLDGSLPGDFGFDPWGLGSDPESLRWNVQAELVHCRWAMLGAAGIFIPEFLTKIGVLNTPFWYTAGEQQYFTDTTTLFIIELILIGWAEGRRWADIIKPGSVNTDPIFPSNKLTGTDVGYPGGLWFDPLGWGSGSPEKIKELRTKEIKNGRLAMLAVMGAWFQAEYTGTGPIDNLFAHLADPGHATIFQAFTPK

SEQ ID NO: 389 - protein, 343 aa, Zea mays
MMIPWGGVGCCLSAAALYLLGRSSGRDAEVLRSVARAGSMKDLAAILDTASKVLPLVVAVSGRVGSDTPLICQQSGMRGVIVEETAEQHFLKHNDAGSWIQDSAVMLSVSKEVPWYLDDGTGRVYMVGARSAAGLILTVASEVFEESGRTLVRGTLDYLQGLKMLGVKRTERVLPTGISLTVVGEAIKDDVGTIRIQRPHKGPFYVSPKSIDQLIMNLGKWAKLYRLASMGFATFGAFLLAKRAIQHFLERKRRHELQKRVLNAAAQRQAREAEGSIGSSDTEPNSKKDQLVLDICVICLEQEYNAVFVPCGHMCCCMACSSHLTNCPLCRRRIDQAVRTFRH

SEQ ID NO: 390 - protein, 505 aa, Zea mays
MYRVASGLGALKRHGANAQMMNAAIRCASTSVAQRSSGGFWTWLTGARSNEIPPPDFTLPGVTIPPPLPDHVEAGKTRVTTLPNGVKIASETSAGSSCSVGVYVDCGSVYEAPETTGASQLLKTMAFTTTANRSELRVVREIEAIGGSAKASASREMMSYTYGALKTYMPEMVEVLIDCVRNPAFLDWEVKEQILRLQAELAKSSSFPENFLLEALHSTGYSGALANPLIVPEYSVSRLNADVLEQFITENYTASRIVLAASGVDHDELVSIAEPLLSDIPSVSGTTRPKSTYIGGEYRRSADSSSTDVALAFEVPSGWLKEKDCVTVSVLQALLGGGGKFSWGRQGKGLHSRLNRLVNEFDQIKSISAFKDVHSNTGIFGIHTSTDASFVPKAIDLAARELTSLATPGQVDQSQLDRAKASAKYAILANLESQASLTEDMGRQVLAFGERKPAEHLLKAVDGVTMKDITSVAEKIISSPLTMASHGNVLNMPTYESVSGKFRSK

SEQ ID NO: 391 - protein, 767 aa, Zea mays
MIDHPVGYSGGSTQSIPVVGSPQPAASSPRRPQTAQQYLQPALHSPSVPTCACAAHAQAQLLKTAPRRAAAAEAPGFPFLYPSPPASPCSIPPSPHCQLAPKREEDDAGCHCHCRAAPLPSPLPPRELDATMLSTRTAAVAASASPASPWKLGGRSEGGASCDGCRTYRNTLRRRAAPAKVRALPPRRVDAVAMVSNAETETEKEQEEAAAASEELPVMPWATSVASGYTLLRDPHHNKGLAFTEEERDGHYLRGLLPPAVLSQELQIKKFMNTLRQYQTPLQRYIAMMNLQETDERLFYKLLIDNVVELLPFVYTPTVGEACQKYGSIFGRPQGLYVSLKDKGKVLEVLRNWPHRNIQVICVTDGERILGLGDLGCQGMGIPVGKLALYTALGGVDPSVCLPITIDVGTNNEKLLNDEFYIGLRQKRATGEEYDELIEEFMSAVKQFYGEKVLIQFEDFANHNAFDLLEKYSKSHLVFNDDIQGTASVVLAGLLAALKMVGGTLAEQTYLFLGAGEAGTGIAELIALEISKQTNAPIEECRKKVWLVDSKGLIVDSRKGSLQPFKKPWAHEHEPLKTLYDAVQSIKPTVLIGTSGVGRTFTKEIIEAMSSFNERPIIFSLSNPTSHSECTAEQAYTWSQGRSIFASGSPFAPVEYEGKTFVPGQSNNAYIFPGLGLGLVISGAVRVHEDMLLAASKALADQATQDNFEKGSIFPPFTSIRKISAHIAAAVAAKAYELGLATRLPPPSDLVKYAENCMYTPVYRNYR

SEQ ID NO: 392 - protein, 135 aa, Zea mays
MVFFSFRFLVSFDLVLCNHSLLLQVLQQRSSRAPWASCISCCGTHLHSPGTHRSLCGTDNLYIKRGMNLRLLEMRTQALIFTVLAAIHRSLWHRSSETQSEENAVAGPGIQKELVISVIVAYSCNHPSCITISSC

SEQ ID NO: 393 - protein, 639 aa, Zea mays
MATTEDSAAAGEARRLFALLESQQQVLSDCHGAWSRALAHFASREEDLASRSAALDEALAAADVSTSETLAALEARESSIPARLAEASAALSAAVAEAETESTGPPPTDIKGALRWICRRMDAAALWRFMAARRRELAVVRREAGPAVAMAVDPPRLVLDVVSDFLAAGDGVGGDQCWVLGMLLRSLFDLDGRKPPEIGDTLVERAFAVTKEWQERFGINMDNLSSEDKEVEMAEADGSENSGATEKKEGKEDEEQEEVEEEDEEEEEEEDPEEEEEEEEEDDPEEVEEPEAPGKEGNEVKGEGAEGKVSEEGEGAGGKVSEEGEGAEGRVSEEGQGAEGKVSQEGQGAEKIGHEDEKKGAAVGTMKVKTGEEGNKGASEQSEAQIFVQMVAAFGLKDKFDEEFLRRLFVANGRKRELARIACVLGFEESLGDIVEELIKSGNAIEAIYVAHEADLLGKFPPVPLFKSYLQNSTDKAQAVLKSGRHSSSALEEANSLEGNAYRSVIRCVESCQLQSVFPLEVLRKKLGKLEKEKSDRKKAAGPSRFPNKRSRGAAGPYPFPAAKAARGSSFGPRFQNPVSRSLNYAPHAGYINPAAASPFSVPGSVSGRRGGVPYGGPGATYGGSPSFATGGGQQPFRR

SEQ ID NO: 394 - protein, 564 aa, Zea mays
MGLRINDLPSSSRTVQTLGYRVGNPGTSHAPFVHFHAGSSGSHLPDPAVNYPHRSEEGFAPVGSHMDNRRAAMKRKGPSVHPAGISATGYYVGSSSSTQPSNSVQPNAAPLAEPFLRQIPLSIDQSGWDIQHLIHQEGFQRNVRARHSSIPLVPRSASTYPLNINSVHVPSFGSTASASSSAPVEMNQVPVSLPTRTLPSGAPGMTSRVPTGRAYYPVVGSSSSSSSVGAVPTIHGSSGAAMFANGGYVPSSVHAGTVPIFPNPAPATSSGSRAMPHQMVIQSHPAATSAATSTSMRTAQPSLPARTAAASRHARHVSAGLANNGRYRRARSSYYRLHPLMVEAEVDSLFLPYCFNEVEFKSLSNLKLMLLLVVKRFMMDHLVFYESRAAAADPHRDMRLDIDNMSYEDLLALGEAMGNVNTGLADEKVSECVKEVVCCSSDHTQMDQDDGSCAICLVYFIKHVPVKDTLITITTHSTMAPEICWTLLLLTDGCVRSPTGGLQRQGGAGNTQVQARLPRRLHQEVAADEELVPGVQSGRGLVGRDTPDEEEEEQATVALDPIHF

SEQ ID NO: 395 - protein, 149 aa, Zea mays
MADQLTDEQIAEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMIREADVDGDGQINYDEFVKVMMAK

SEQ ID NO: 396 - protein, 903 aa, Zea mays
MESHNGEANDLPPPPPLIAGVEPLKADETKMPLKPRSLVQRNGFGRKGQPIKLITNHFKVSLVNAEEFFYHYYVNLKYEDDTPVDRKGSGRKVIEKLQQTYAAELANKDFAYDGEKSLFTIGALPQVKNEFTVVVEDFSTGKTPANGSPGNDSPPGSDRKRVRRPYNTKTYKVELSFAAKIPMSAISQALRGQESEHTQEAIRVIDIILRQHSAKQGCLLVRQSFFHNNPSNFVDLGGGVVGCRGFHSSFRATQSGLSLNIDVSTTMIVKPGPVIDFLLDNQKVGDPSMIDWAKAKRALKNLRIKISPANQEQKIVGLSERTCREQLFTLKHKNGNNGDSEEITVYDYFVKQRGIVLQYSGDLPCINVGKLKRPTYFPIELCSLVPLQRYTKALNTLQRSSLVEKSRQKPQERMSVLSDVLQRSNYDAEPMLKACGITIARNFTEVDGRVLQPPKLKAGNGEDIFTRNGRWNFNNKRLIRACSVEKWAVVNFSARCNVRDLVRDLIKCGGMKGIMVDAPFAVFDENPSMRRSPAIRRVEDMFEQVKTKLPGAPKFLLCVLAERKNSDIYGPWKKKCLAEFGIVTQCVAPTRVNDQYLTNVLLKINAKLGGMNSLLQIETSPAIPLVSKVPTIILGMDVSHGSPGHSDVPSIAAVVSSREWPLISKYRASVRTQSPKMEMIDSLFKPREAEDDGLIRECLIDFYTSSGKRKPDQVIIFRDGVSESQFNQVLNIELQQIIEACKFLDEKWNPKFTLIIAQKNHHTKFFIPGKPDNVPPGTVVDNKVCHPKNFDFYMCAHAGMIGTTRPTHYHILHDEIGFSPDDLQELVHSLSYVYQRSTTAISVVAPICYAHLAAAQVGQFIKFDEMSETSSSHGGHTSAGSVPVQELPRLHEKEGSSWYDVKC

SEQ ID NO: 397 - protein, 196 aa, Zea mays
MRFLKVDRKTVDLVGNEKLKASASVKHLALPCNKAATAQVIPDIIRCYSHGGRTIIFTETKDSASELSGNTGVAVMLYEPRYKHSVSRLERESGVKFEHISAPQPTDVAQSAGSEAADAIASVSDSVIPIFRQQAEQLLSSSSLSAADLLAKALAKAVGYTDIKKRSLLSSLEDYSTLHLQTGRPMWSPGFAITFR

SEQ ID NO: 398 - protein, 37 aa, Zea mays
MMQFNESASVFSCCQSGQQLICNQTLCTIMQTRLLVC

SEQ ID NO: 399 - protein, 805 aa, Zea mays
MPPATAMAPPSQPPSNSGDPLYPELWRACAGPLVTVPRVGDLVFYFPQGHIEQVEASMNQVAGNQMRLYDLPPKLLCRVLNVELKAETDTDEVYAQIMLMPEPEQTDVPAEKPSSAPAASPRPAVRSFCKTLTASDTSTHGGFSVLRRHADECLPPLDMTQSPPTQELVAKDLHGMEWRFRHIFRGQPRRHLLQSGWSVFVSSKRLVAGDAFIFLRGENGELRVGVRRAMRQLSNVPSSVISSQSMHLGVLATAWHAINTKSMFTVYYKPRTSPSEFIIPYDQYMESVKNNYSIGMRFRMRFEGEEAPEQRFTGTIVGCENLDPLWPDSSWRYLKVRWDEPSTIPRPDRVSPWKIEPASSPPVNPLVHSSRAKRPRQNVPPPSLESSVLTKEGATKVEIDSAQTQHQNSVLQGQEQMTLRNNLTESADSDSTVQKPMMWSPSLNGKAHTHFQQRPAMDNWMPLGRRENDFKDTRSAFKDARTASQSFGDTQGFFVQAYDDNHHRLSFKNQGSTHRFADPYFYMPQQSSVTVESSTRTQTANNDLCFWGDQNAMYGNPSDQQQGFNFGQNPSSWLNQPFPQVEQPRVVRPHATVAPFDLEKTREGSGFKIFGFQVDTTSPSPVQLSSPLPAIQEHVLQTRPSAPVNELQPVQIECLPEGSVSTAGTATENIQQAPQSSKDIQSKSQGASTRSCTKVHKQGVALGRSVDLSKFTDYGELQAELDKMFDFEGELVSGSQNWQIVYTDDEGDMMLVGDDPWEEFCSIVRKIYIYTKEEVQKMNSKSAAPRKEESPAAGGGGGCAAATNE

SEQ ID NO: 400 - protein, 486 aa, Zea mays
MLIKKKLAQQQQLLQQQSNSQQLPQQHQLQQPAVSSQQSQSSNQHLQQEKLGIGSMPVDGGIPNSFGGAEQTAKKRKKPGSSSGRANSSGTANTAGPSPSSAPSTPSTHTPGDAMSVPQLQQNGGSAKPMVMFGSDGTGSLTSPANPLDDVDRLLEDGSLDDNVESFLSQDDMDPRDNLGRCMDASKGFGFSEVAKARASAAKVVCCHFSADGKLLATGGHDKKVTLWCTDSLKPKSFLEEHSFLITDVRFSPSMSRLATSSFDKTVRVWDADNTDYSLRTFTGHSASVMSLDFHPNKEDMICSCDGDGEVRSWSINNGSCLTCVKVFKAGATQMRFQPRKGKYLAAASEKAIYILDGETQHACRSPLQGHNKNIQSLCWDSAGEYLASVSEDSVRIWSFSSGRDGEFVHELNRSGNQFHSCVFHPTYQSLLVIGCYESLELWDIREKNTMTFNNAHDGLVAALAASSATGKVASVSHDRTLKLWK

SEQ ID NO: 401 - protein, 507 aa, Zea mays
MASPAPASPAAAAAHCPPPRIGLAGLATMGQNLALNIAEKGFPISVYNRTAAKVDSTLSRARDEGSLPVLGHRDPRGFVLSLARPRAVVLLVQAGPAVDATIQALSPYLEPGDAIVDGGNEWYQNTERRIQEAAARGVLYLGMGVSGGEEGARNGPSLMPGGSADAYANIRDILQKAAAQTEDGACVTFVGPGGAGNFVKMVHNGIEYGDMQLIAEAYDVLRRLGGLSNSEIADVFAEWNRGELESFLVQITADIFTVADPLDGSGSGGGALVDRILDKTGMKGTGKWTVQQAAELAVAAPTIAASLDGRYLSGLKDERVAAAGVLEEEGMPAGLLETVNVDKKVLVDRVRQALYASKICSYAQGMNLLRAKSVEKGWNLNLAELARIWKGGCIIRARFLDRIKSAYDRNPELANLIVDREFAREMVQRQNAWRWVVARAVEAGISTPGMTASLSYFDTYRSSRLPANLIQAQRDLFGAHTYERIDCPGSFHTEWTKLARRSNGAAI

SEQ ID NO: 402 - protein, 642 aa, Zea mays
MLKPSPGGGLHARARPRHLPPRPDPRHGRRAAPGPGPRCTAPLQTGPVLENNPSKSANAKDQILSGTENVTTGNARGASSLRSPNGPPEKASSVGKAGEQPYLYQQNVYAPQPQPLYPGGYMNPSGQWEEYPHYVNMEGLHSVSPVSCWNYRASLCFLDFFLNIFFLKGIYNDNQSLMLSAGYANNPQMMYGAYSPVSTAGDGQQYFPVHYSFSNPYYQPPASPSMGYSNSATGMSQGDPMLQQEYFLPDGLLYSPTPGYHQPFSSFDRALTQPNNAPGLFGQGSLPLASGMHHGSMYGPGSYKGRQYGSKFGGTTPSWSSAGRRFGTFDLSGNQQRGSMSFGSHNGSLEFMNEQNRGPRATKPKIQDTENSGDEKSEKTVPLIDSELYNRSDFITEYKDAKFFVIKSYTEDHVHRSIKYNVWASTASGNRKLDSAYRAAREKEEHCPIFLFFSVNGSGQFCGVAEMIGPVDFDRSVNYWQQDKWSGQFPVKWHIIKDVPNNLLRHIILENNDNKPVTNSRDTQEVKLEQGLQMLTIFKSHEAETTIVEDFDFYEQREKALQENRRQQHAASTDTQKLVDTKAQDAVADISDAFAKAVQLKNTENSGTTPKTEGASAEKGSAATAKVEGSANLNTGPVEESS

SEQ ID NO: 403 - protein, 803 aa, Zea mays
MVGGGNEFRFFLSCDISHPLAFRVLHAEHILLTDQKVPELFVECKLYIDGIQFGLPVKTRLEPSGPKYCWNELITLSTKYRDLTSLSQLAFTVWDVSSGENPEVVGGATIFLFNSKRQLKTGRQKLRLWPTKEADGGVPTTTPGKVPRNERGEIERLERLVNKYERGQIQHVDWLDRLAFSAMDKAMEKECERKANLYPSLVVELCSFEHRIVFQESGANFYTPAPVSLSNELVTVWDPELGRTNPSEHKQLKLARSLTRGIVDRDLKPSSNERKLLQTIIKFPPTRTLEVDEKQLVWKFRFSLMSEKKALTKFVRSVDWSDNQEAKQAVELIGKWEMIDVADALELLSPDFESDEVRGYAVSVLERADDEELQCYLLQLVQALRFERSDKSRLALFLVNRALSNIEIASFLRWYILVELHSPAYARRYYGTYDMLENSMMKLVGREDGDEDGFRLWQSLTRQTDLTAQLCSIMKDVRNVRGSAQKKIEKLRQLLSGVFSELTNFDEPIRSPLAPTLLLTGVVPQESSIFKSALNPLRLTFKTANGGTSKIIYKKGDDLRQDQLVIQTVSLMDRLLKLENLDLHLTPYRVLATGQDEGMLEFISSSSLAQILSEHRSITSYLQKFHPDEDGPFGITAQCLETFIKSCAGYSVITYILGVGDRHLDNLLLTDDGRLFHVDFAFILGRDPKPFPPPMKLCKEMVEAMGGAESQYYTRFKSYCCEAYNILRKSSSLILNLFKLMERSGIPDISADESGGLKLQEKFRLDLDDEEAIHFFQDLINDSVSALFPQMVETIHRWAQYWR

SEQ ID NO: 404 - protein, 89 aa, Zea mays
MYWDDKYGTHSVSAEVVARMRDMVSNDMQNPVSNSFLLDDDLSIPFTTEEIAEQVPDVDMSNIETPASLRHVHSAQFLTQHLQPPYTSR

SEQ ID NO: 405 - protein, 157 aa, Zea mays
MKGAKSKGAAKADAKLAVKSKGAEKPAKGRKGKAGKDPNKPKRAPSAFFVFMEEFRKEFKEKNPKNKSVAAVGKAAGDRWKSLSESDKAPYVAKANKLKLEYNKAIAAYNKGESTAAKKAPAKEEEEEDEEESDKSKSEVNDEDDEEGSEEDEDDDE

SEQ ID NO: 406 - protein, 245 aa, Zea mays
MVMASSSGLRSCSAVGVPSLLAPSSRSGRLAPFCANATTSGRVTMSAEWMPGQPRPAHLDGSSPGDFGFDPLGLATVPENFERFKESEVYHCRWAMLAVPGILVPEALGLGNWVKAQEWAAVPGGQATYLGAPVPWGTLPTILVIEFVAIAFAEHQRTMEKDPEKKKYPGGAFDPLGFSKDPAKFEEYKLKEIKNGRLAMLAFVGFCVQQSAYPGTGPLENLASHLADPWHNNIGDIIIPRSISP

SEQ ID NO: 407 - protein, 766 aa, Zea mays
MAAAAILPELATQVLIPVAAAVGIAFAVVQWVLVSKVRVTPERRADGGAVKSGPSDYLIEEEEGLNDHNVVVKCAEIQTAISEGATSFLFTEYKYVGLFMGIFAILIFLFLGSVEGFSTKSQPCHYIKDQTCKPALANAIFSTIAFVLGAVTSLVSGFLGMKIATYANARTTLEARKGVGKAFITAFRAGAVMGFLLAASGLLVLYIAINLFGIYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTPMVYPLLVSSVGIIACLITTLFATDFFEIKAVDEIEPALKKQLIISTIVMTIGIALISWLGLPYTFTIFNFGVQKTVQSWQLFLCVAVGLWAGLVIGFVTEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNNIPGLMEGTTKPDYATCVKISTDASIKEMIPPGALVMLTPLIVGILFGVETLSGVLAGALVSGVQIAISASNTGGAWDNAKKYIEAGVSEHARTLGPKGSDPHKAAVIGDTIGDPLKDTSGPSLNILIKLMAVESLVFAPFFAAHGGILFKWL

SEQ ID NO: 408 - protein, 1929 aa, Zea mays
MQEELGQRMHVPHGINLCFSTSSELFQVESSIELGTAEVNPVPSEKLSANSQAVRDDAGAVEGIDMNGKPVQKPKRKKHRPKVIKEGQSAKLQKPKTPKPPKENGNQPTGKRKYVRKKGLSTPAKQIPSEGADTHTRAKPGIAQRCLDFDVEDQHGHLDLVSQTQETEIQTGPGDTQPSISGVERSNAQVSCHWGWGGTSSSIISADPIVDIQGLQADCIPKRVNFDLNNSMASQMPTNYSSRMDSSGQFFQFGLGEKVQTNQLLDYNCNLPARRVSHLSSSVDHMRHPLANFDQYISTSQVCTENSRRHYQMPSSSRISENRTAASQYTERVSMGGNFNPGACIGEGTVIKQMAQCYRLPESPLVPPKHNERDVMNGNLNEFSVYNDYLNFSSNSNYQTGAAFGFHDSPVYSDVLAMGKKREHNAISGHQISFDIDFVNSNSTRKFCIDDLLSTSSQTSYYPEACKRMRPENHSNQLNVTTGKLSSSSAFSGSLNTNNVSTINPGIGTLADIQRLMALEKSQASQQMIDFITSQNNMAGESTELAQQNNSDKGFVALHNKKFQSLTAQNIPLPDSTVNQSGESNILRNGIHQTQPWEITSRSHHSSDNFALPNKWSGYLTAGNTQLSSITVNPSTENYIQSNAIYQYQCLENVVAKVPVLSGTHNTSSQEGHNHSTAATNEHIRTTSEEVVRSFTQRASEPTTHGNYNLNSSRVTAEANSTEKPRKRGRPRKVVKPNGEPKERGTKGKQNVSHEKPTSQKGSHTDILKTNGISYASEPSTGITPRMAIVESKSSDQDKEIHGGVIPQATAISVDLLDGIIQKIKLLSISRPDNVVAEIPKDALVPYEGEFGALVAFEGKTKKNRSRAKVNIDPVTTMMWNLLMGPDMGDGAEGLDKDKEKWLDEERKVFRGRVDSFIARMHLVQGDRRFSRWKGSVVDSVVGVFLTQNVSDHLSSSAFMAVAAKFPAKPEVPEKPVAEMSHTPEQKDSCSCSGLFGDSIKLQGKMFIEEISDVRSLITTEDNEESNSNELIGSSAGYGVNHATGGCHVSYRKSLTESHENGLSGSVFPTTGFSSVVETEDGSLEDVISSQNSAVSSQNSPDYLFHRTDPIGSSSLQNFTEEGYIMRNISNGTGSSTDCSGFLPIQDPKGTLGLSEYYGHNPLLVSGVNKGVLLDLNRSYQPLHTSMPYVQNSESDFTGVSCFSHMDKSFHTGPNRVNLSSVTQSEASLYPTDPLQQDEFSPVIKQNFQPLYSSDKVSLFKEHCSYGNDFSRNKTEAAIMEPLVYSNPQELYTTSTEQMGVEQFQSGCGQQDNDVRVQTTSYERHQSSTLCGNQNSQLEILQGVASGSTQKFIDTQKSPSEVQQNGSKAKKVRGRPKTKTYDWDSLRKEVFSNGGDKQRNNDARDTVDWEAVRQAEVREISETIRERGMNNMLAERIKEFLNRLVTDHGGIDLEWLRDVPPDKAKDFLLSIRGLGLKSVECVRLLTLHHMAFPVDTNVGRICVRLGWVPLQPLPESLQLHLLEMYPMLEHIQKYLWPRLCKLDQRTLYELHYQMITFGKVFCTKSKPNCNSCPLRAECKHFASAFASARLALPAPEEKRLATSEDPNVVEFCHQTYINSGAVGELEWSANYPKHAVCGNLQPFIEEPLSPEPEPENVEAKDGAIEDFFNEDPDEIPTINLNIEEFTQNLKNYMQANHVEIEYADMSKALVAITPEAASIPTPKLKNVSRLRTEHQVYELPDSHPLLEGFEQREPDDPCPYLLSIWTPGETAQSTNAPKTFCDSGETGQLCGSLTCFSCNSLREMQAQKVRGTLLIPCRTAMRGSFPLNGTYFQVNEVFADHCSSQNPIDVPRSWIWDLPRRTVYFGTSVPTIFRGLTTEEIQQCFWRGFVCVRGFDRTVRAPRPLYARLHFPASKVVRGKKPGAASVEE

SEQ ID NO: 409 - protein, 341 aa, Zea mays
MAAAIDMYKYYNTSAHQIPSSSPSDQELAKALEPFITSASSSSSSSPYHGYSSSPSMSQDSYMPTPSYTSYATSPLPTPAAASSSQLPPLYSSPYAAPCMAGQMGLNQLGPAQIQQIQAQFMFQQQQQQQRGLHAAFLGPRAQPMKQSGSPSPPPPLAPAQSKLYRGVRQRHWGKWVAEIRLPKNRTRLWLGTFDTAEDAALAYDKAAFRLRGDTARLNFPALRRGGAHLAGPLHASVDAKLTAICQSLSESKSKSGSSGDESAASPPDSPKCSASTTEGEGEEESGSAGSPPPPPPPPTLAPPVPEMAKLDFTEAPWDETEAFHLRKYPSWEIDWDSILS

SEQ ID NO: 410 - protein, 227 aa, Zea mays
MGREWELSFRLGMRPWIAVAYSAPVAAATAVFLIYPIGQGSFSDGMPLGISGTFNFMIVFQAEHNILMHPFHMLGVAGVFGGSLFSAMHGSLVTSSLIRETTENESANEGYKFGQEEETYNIVAAHGYFGRLIFQYASFNNSRSLHFFLAAWPVVGIWFTALGISTMAFNLNGFIFNQSVVDSQGRVINTWADIINRANLGMEVMHERNAHNFPLDLAALEVPYLNG

SEQ ID NO: 411 - protein, 795 aa, Zea mays
MEQDPERACLRSFELHESESSLYVLGTNSDRTLWRLLKIDRSEPSELVIDECSTVYTESEHPDLLKGLDDEHRSTGGVKFVTKFYGIIGFIKFLGPYYMLIITEQKKIGEIFGHPVYQVTRTSMVELANSKTRSTFQNFKDENRYRKILNALDLRKDFFFSYSYHIMRSLQKNLADPQDGWTLYETIFVWNEYLTRRIRNCLRNTLWTVALVHGFFKQDKFSISGKDIMFTLIARRSRHYAGTRYLKRGVNEKGRVANDVETEQIVYEAVPGPTEVSSVVQNRGSIPLFWSQETSKLNLKPDIILHEMQNNYEATELHFENLRARYGNPIIILNLIKTRERRESILRREFDKAIKIINKSLSEENHLRFLHWDLHQNSQGKPTNVLDVLLKVAFRALNLTEFFYCQVAPNSETSAQCPTLLNGLDQYLCDDNNSDDTECTEIVGDVSQEDISGSSDSSGNATTEDKFENSGLPPPKPPKFQKGVLRTNCIDCLDRTNVAQYAHGLAALGHQLHALGFIESPELGLEAPLAHHLMHFYEMMGDTLAVQYSGSAAHNKVFSAKRGHLKLFIQSQEFFRTLQRHYSNTCIDANKQAAINLFLGYFQPQQEKPALWELESSAGKHNNNLFDGHPSTLKRVKSDGTILHESNASISGSGRCHNEQLSASQPDVQNGFQFPTSESDSLHENDISSACGSGVAHLRYTPTASDVLHVPRAKVEYCHDSGDSNFLDLEWLSTSGNSSDERSIATSTPDANLSNENVISGITPDIMENHLAEMQYQKLPRNFVQWVNHGDTFWY

SEQ ID NO: 412 - protein, 588 aa, Zea mays
MVKKPNGVAKATATSADAAAQPSKENPSTPGLVKASKFKKRKVKANRAKQAVAAAAIDEVAPVGAGTGDGDASASAALPQPSDVAEALLVVQTPKSTTFAEASPVAQTQKPATDAEGLVPAPIPTTAVASASSPKPKPAQANADAAAAISASKGNGVGADNSRGDGEMKNKKERAMSDKGKEVMEEGGSKGKGKGKGKKAVVKKEERGDRKVAGFIFMCNAKTKKECYQSRLFGMPSGKIEMVKKIRPGVKLFLYDFDLKLLYGVYKAASHGGLNLVHEAFNGKFPAQVKFKIDKDCRPLPESSLKQAIKENYNAKSKFDPELTTKQVQRLLLLFKPVSAPQSVSNNHLGERRHYEKRRKPRHFEERRPIEAARRPRFDEERRPAVRHVPFEDPYRAPRYAPVPVDSQHGHSLASDHHRYYQPALTPEPRQLPLVLEPRYVPPALDHHHVPELRHAPPAYYRTLAPSGDSYYRSVENLVPERYADRTMADLTTRDPIIRDHTALPGEALARADRLDDLYRSDRVEELYRSDRLVNRAVDRPHPAYFTAAYETNPAYAETSIRPVSARVNGPSAAVSSLYSFSGGPVYR

SEQ ID NO: 413 - protein, 212 aa, Zea mays
MAKMVLLCVLVSFLLMPLASLALTQDFCVADLTCSDTPAGYPCKSSVTANDFYFHGLAGQGKINPLIKAAVTPAFVGQFPGVNGLGISAARLDIEVGGVVPLHTHPAGSELLFVTQGTVAAGFISSGSNTVYTKTLYAGDIMVFPQGLLHYQYNAGTGAAVGLVAFSSPNPGLQITDFALFANNLPSAVVEKVTFLDDAQVKKLKSVLGGSG

SEQ ID NO: 414 - protein, 447 aa, Zea mays
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKIAFVPISGFEGDNMIERSTNLDWYKGPTLLEALDQITEPKRPSDKPLRLPLQDVYKIGGIGTVPVGRVETGVIKPGMVVTFGPTGLTTEVKSVEMHHEALQEALPGDNVGFNVKNVAVKDLKRGFVASNSKDDPAKEAASFTSQVIIMNHPGQIGNGYAPVLDCHTSHIAVKFAELITKIDRRSGKELEKEPKFLKNGDAGMVKMIPTKPMVVETFSAYPPLGRFAVRDMRQTVAVGVIKSVEKKDPTGAKVTKAAAKKK

SEQ ID NO: 415 - protein, 445 aa, Zea mays
MDEEYDVIVLGTGLKECILSGLLSVDGLKVLHMDRNDYYGGDSTSLNLNQLWKRFRGEDKPPAHLGASRDYNVDMVPKFMMANGTLVRTLIHTDVTKYLSFKAVDGSYVFSKGKIYKVPATDMEALKSPLMGLFEKRRARNFFIYVQDYNEADPRTHQGLDLTRVTTRELIAKYGLSDDTVDFVGHALALHRDDRYLDEPALDTVKRMKLYADSLARFQGGSPYIYPLYGLGELPQGFARLSAVYGGTYMLNKPDCKVEFDMEGKVCGVTSEGETAKCKKVVCDPSYLQNKVRKIGRVVRAIAIMSHPIPNTNESHSVQIILPQKQLGRRSDMYVFCCSYTHNVAPRGKFIAFVSAEAETDNPQSELKPGIDLLGSVDEIFYDIYDRYEPVNEPSLDNCFVSTSYDATTHFETTVTDVLNMYTMITGKTVDLSVDLSAASAAEEY

SEQ ID NO: 416 - protein, 483 aa, Zea mays
MSCREGLMSPQTETKASVGFKAGVKDYKLTYYTPEYETKDTDILAAFRVTPQLGVPPEEAGAAVAAESSTGTWTTVWTDGLTSLDRYKGRCYHIEPVPGDPDQYICYVAYPLDLFEEGSVTNMFTSIVGNVFGFKALRALRLEDLRIPPAYSKTFQGPPHGIQVERDKLNKYGRPLLGCTIKPKLGLSAKNYGRACYECLRGGLDFTKDDENVNSQPFMRWRDRFVFCAEAIYKAQAETGEIKGHYLNATAGTCEEMIKRAVFARELGVPIVMHDYLTGGFTANTTLSHYCRDNGLLLHIHRAMHAVIDRQKNHGMHFRVLAKALRMSGGDHIHSGTVVGKLEGEREITLGFVDLLRDDFIEKDRSRGIFFTQDWVSMPGVIPVASGGIHVWHMPALTEIFGDDSVLQFGGGTLGHPWGNAPGAAANRVALEACVQARNEGRDLAREGNEIIKAACKWSAELAAACEIWKEIKFDGFKAMDTI

SEQ ID NO: 417 - protein, 501 aa, Zea mays
MDTVGVPVVAVANGIGEVERKVQKSYWEEHSKCLTVESMMLDSRAADLDKEERPEILSLLPSYKGKSVLELGAGIGRFTGDLAKEAGHVLALDFIESVIKKNQSINGHHKNITFRCADVTSNDLKIEDNSVDLIFSNWLLMYLSDEEVQKLVGKMVKWLKVGGHIFFRESCFHQSGDSKRKVNPTHYREPRFYTKVFKEGHSFDQDGGSFELSLVTCKCIGAYVKNKKNQNQICWLWEKVKSTEDRDFQRFLDNVQYKTSGILRYERVFGEGFVSTGGIETTKEFVGMLDLKPGQKVLDVGCGIGGGDFYMAANYDVHVLGIDLSVNMVSFAIERAIGRKCSVEFEVADCTTKDYPENSFDVIYSRDTILHIQDKPALFRSFFKWLKPGGKVLISDYCKNPGKPSEEFAAYIKQRGYDLHDVKAYGQMLKDAGFHNVIAEDRTEQFLNVLQREIGEVEKNKDAFLADFTQEDYDDIVNGWNAKLKRSSAGEQRWGLFIATK

SEQ ID NO: 418 - protein, 2036 aa, Zea mays
MAQNSSRLHRLLTLLDTGSTQATRFAAARQIGEIAKSHPQELNSLLKKVSQYIRSKNWDTRVAAAHAIGAIAENVKHTSLKDLYASVQAEKHASGFSDGSDDAGSALPRTDSAATSDLAFGSFDIGRVLEFGSPLLASGGQEYDIADSGKNPAERLARQKKNLRRRLGLDLCEQFMDVNDVIKDEDLLAQKNYWGSHVQNNGFHSFNSGHNIQQLVSTMVPRYPKHSNFRSRRLSARELNMLKRKAKSNAKDHTKAVSEDDEVTLKGSVPSNGASSEQAGAQNGVFDTAVEEDNLEYNENGRWPFQQFVDQLIHDMFDPIWEVRHGTIMALREILTHHGACAGVYFPDLSLPSSDLDGKTNFDSLKREHGIDLNEDVHLEHLEPALKKHKKEPKCAESMMDCDKELVDSDYLKTEGDLSNVPDVLTAEPNSTHVKVEPEFCVDDSADPSKGVSTCKSQKKLNSISHLSSHILAPESSKFMKLMKLAKYSYMKNWEFLQDCAIRFLCVLSLDRFGDYVSDQVVAPVRETCAQALGAVLKYMHPSLVCHTFKILLQMQHRQEWEVRHGSLLGIKYLVAVRQEMLKDLLDYIIHACKAGLEDPDDDVRAVAAEALIPAADSLVRLNDQILHPIVVLLWDILLDLDDLSPSTSSVMNLLAEIYSQPEMVPKMLGTAASGEKGEFDLNEATQIAEQEDELTSIENPYGLATLTPRLWPFMRHSITSVRRSAIRTLEKLLEVGNTRSSAGTTPSKLWPTSILGDALQVVFQNLLLESNDDILQSSERAWKLLLQCPEKDLEYAARLYFSNWVQLATTPFGSALDSTKMFLPVALPRGNRSRAAAKIRSARLEHEYTTMISFGSTGESISHEKHSDVPSIFSNIIVGSDPDKSVTHTRVLTSMALGLFASKLPVSSWQVVLSPLANHLMSLSGVQRQVASMIIVSWFKDLRGRDPVSVGTLLAFLSSLKEWLVDLLTCSDPALPTKGSVLPYSELSRTYTKMRNEANNLLHLIDSCAAFKDYSSSLNLNTDVLTVDDAINFASKLLLPSESDIPSETENIFLNNIESAKQGLLSTSGYLKCVQNNLHVTVCSLVASAVVWMSCLPSKLNPVILPLMAAIKREQEEVLQDKAADALAELIFSCIGRKPGPNDKLTKNLCTLTCTDASETPQAAIINSMQVIEDQNLLSIGKRFSSHRSRGHTTSGGDERSKMEGFISRRGSELAFKHLCVKFGPSLFENLPKLWDCLTEFLRPVKTEDGIPEDDASIAQLGRSYEDKDPQSLINNIQVVRSISPHLAEPLRPQLLNLLPSILGCVRHPHVAVRLAAARCITSMAKSLTDDVMVLVIENVIPMLSDLSSVCARQGAGILLSLLVQGLAVELVPYAPFLVVPLLKCMSDPDGSVRQTVTHSFAALVPLLPLSRGASLPCGLSERLSSSAEDVQFLEQLLDNTQIDDFKLNIDLNVELRRYQQEGINWLAFLRRFKLHGILCDDMGLGKTLQASAIVASDIAEARARNDEKILTSLIICPSTLVAHWEYEIEKYIDSSILKPLQYVGSSQDRVTLRSQFDKVNVIITSYDIIRKDIDFLGNITWNYCVLDEGHIIKNSRSKITFAVKQLKAQHRLILSGTPIQNNVLELWSLFDFLMPGFLGTEKQFQAAYGKPLLAAKDSKCSAKDAEAGILAMEALHKQVMPFLLRRTKDEVLSDLPEKIIQDRYCDLSLLQLKLYDKFSSSNAKDEISTIVKANELEESAPQPKATRHVFQALQYLLKLCSHPLLVTGENPPNHLVDLLNEIGLGSGSELHELHHSPKLVALQEILQECGIGSEISSPDASTAVGQHRVLIFAQHKAFLDIIEKDLFQSHMRSVTYLRLDGSVDPEKRFEIVKAFNSDPTIDVLLLTTHVGGLGLNLTSADTLVFVEHDWNPMKDLQAMDRAHRLGQRKVVNVHRLIMRGTLEEKVMSLQRFKVSVANAVINAENSSLKTMNTDQLLDLFTSTPASRKASDEQSKRKSGGKGLKSILNGLDELWDQSQYADEYDLNQFLAKLNG

SEQ ID NO: 419 - protein, 77 aa, Zea mays
MGGGNAQKSKMARERNAEKNKGGKGSQLEANKKAMNIQCKICMQTFICTTSEAKCKEHAEARHPKNDLYQCFPHLKN

SEQ ID NO: 420 - protein, 326 aa, Zea mays
MRPILMKGHERPLTFLRYNRDGDLLFSCAKDHTPTVWYADNGDRLGTYRGHNGAVWTCDVSRDSARLITGSADQTAKLWDVSTGKELFSFRFDAPARSVEFAIGDALAVVTTDNFMDHVPTVQVKRIAEDIDDQTEESALVITGIKGRINRAVWGPLNRTIITAGEDATVRIWDSETGQLLKESDKESGHQKTISSLSKSLDWSHFITGSLDKSAKLWDTRTLTLIKTYVTERPVNAVDISPTHDTVVLGGGQDAMNVTMTDRRAGKFEAKFYHKILQEEIGGVKGHFGPINALAFNPDGRSFSSGGEDGYVRLHHFDSDYFSIKM

SEQ ID NO: 421 - protein, 1094 aa, Zea mays
MEASAGLVAGSHNRNELVVIRRDRESGAAGGGAARRAEAPCQICGDEVGVGFDGEPFVACNECAFPVCRACYEYERREGSQACPQCRTRYKRLKGCPRVAGDEEEDGVDDLEGEFGLQDGAAHEDDPQYVAESMLRAQMSYGRGGDAHPGFSPVPNVPLLTNGQMVDDIPPEQHALVPSYMSGGGGGGKRIHPLPFADPNLPVQPRSMDPSKDLAAYGYGSVAWKERMEGWKQKQERLQHVRSEGGGDWDGDDADLPLMDEARQPLSRKVPISSSRINPYRMIIVIRLVVLGFFFHYRVMHPAKDAFALWLISVICEIWFAMSWILDQFPKWLPIERETYLDRLSLRFDKEGQPSQLAPIDFFVSTVDPTKEPPLVTANTVLSILSVDYPVEKVSCYVSDDGAAMLTFEALSETSEFAKKWVPFSKKFNIEPRAPEWYFQQKIDYLKDKVAASFVRERRAMKREYEEFKVRINALVAKAQKVPEEGWTMQDGSPWPGNNVRDHPGMIQVFLGQSGGRDVEGNELPRLVYVSREKRPGYNHHKKAGAMNALVRVSAVLSNAAYLLNLDCDHYINNSKAIKEAMCFMMDPLVGKKVCYVQFPQRFDGIDKNDRYANRNVVFFDINMKGLDGIQGPIYVGTGCVFRRQALYGYDAPKTKKPPSRTCNCWPKWCLSCCCSRNKNKKKTTKPKTEKKKRLFFKKAENPSPAYALGEIDEGAPGADIEKAGIVNQQKLEKKFGQSSVFVASTLLENGGTLKSASPASLLKEAIHVISCGYEDKTDWGKEIGWIYGSITEDILTGFKMHCHGWRSIYCIPKRPAFKGSAPLNLSDRLHQVLRWALGSVEIFFSKHCPLWYGYGGGLKFLERFSYINSIVYPWTSIPLLAYCTLPAICLLTGKFITPELTNVASIWFMALFICISVTGILEMRWSGVAIDDWWRNEQFWVIGGVSAHLFAVFQGLLKVFAGIDTSFTVTSKAGDDEEFSELYTFKWTTLLIPPTTLLLLNFIGVVAGISNAINNGYESWGPLFGKLFFAFWVIVHLYPFLKGLVGRQNRTPTIVIVWSILLASIFSLLWVRVDPFLAKSNGPLLEECGLDCN

SEQ ID NO: 422 - protein, 266 aa, Zea mays
MAVVGLSSAFAPLRGSWIAVRIRQGGQRAGISLCPSPRSRRSCAAVVRAEVSFVDADEAKRLVGEEGYTVLDIRDRAQRERAHIKSSTHVPLFIENQDNDIGTIVKRQLHNNFAGLFFGLPFTKLNPDFALTVKDKFSPESKLLVVCQEGLRSAAAADALEKEGFQNIACITSGLQTVKPGTFESVGKSELQNAGKAGLVTIQGKISVVLGTVLISKIIGLPSFRDNQMYQLITLSYGRSCAGAYLFITFFPDQAEKLFDLAGISL

SEQ ID NO: 423 - protein, 304 aa, Zea mays
MAAAPSSLVSSHLSRLADLRRAAAPATPTVPQQLRVGFSRRRAQRVVAMAGSGKFFVGGNWKCNGTKDSVSKLVSELNAATLETDVDVVVAPPFIYIDQVKNSLTGRIEVSAQNVWIGKGGAYTGEISAEQLVDIGCQWVILGHSERRHIIGENDEFIGKKAAYALSQNVKVIACIGELLEEREAGKTFEVCFEQMKAFADSISNWADVVIAYEPVWAIGTGKVATPEQAQEVHAAVRDWLTTNISPDVASSTRIIYGGSVNAANCAELAKKEDIDGFLVGGASLKAPDFATIINSVTAKKVAA

SEQ ID NO: 424 - protein, 1353 aa, Zea mays
MEADAPLDLALFQLSPRRQRCELVVCGNGRTEKIASGSVKPFVAHLRAAEEQASAQPPPLAIRLQLERPAPWFSKGTLERFVRFVSTPEVLELANTYDLEMSQLEGARKIYAQGGTGDATSGGAAENVTASAAAAADITKKELLRAIDVRLSSLKQDLAAACSRASSAGFNPISVSELILFANHFGASRLSEACTKFMSLCQRRPDISPQTAQPAVSSHWKVFDDGNVRGSSSSDMSIDEPLVDLSESKNKSTVSGSGSQVHRLSNIQGLESAAAQQPKPTIQQAVDKQEAETDASPAPSKGELSRRLSVKDRINMFESQKKEQTPSSGNSNSAGTGRVVPGKGEHRRVPSGASMEKLVRRWSSVSDMSIDLSNNESSSLNDKKDNGTPAGTPTSTDLEADSKVRANEDSNGQKDSITSHSWPCQKDNVPMDLATTDLCPPSILSNTLAPHKESIYGDGAENDMVMNSSIESEASFGKEPGVIQGHTRMSNHATSNVSTQDRLKSSAKSVEEALLKNKVIVTSASSEEHVCMIDKEITAVAHEVPVASEQIPQNDIRGLHTKDIHTEAEVTGRKDQPSRSFGRVSGGVNPKPKASSNSRANAKGSSVRDAIASTETEFRDVSLQRNRLPRKSEDVGKKVTAGSDSDCSGRQGKNLSRQSSITDQELNLQARVTRPGKGNQDRHGELQMKANELEKLFAEHKLTSSRRGKPTDVQVESTPMVSEVKPTMVLHETIHTKQVVKESITVNDFDAGELLKMVNNQEFNISTPQKLGILSLEESRGKFYEHYMQKRDAKLKEGWKLQREEKEAMLKAMHDSLERSKAELLTKFSRSADVPDSTYVSHCSQKIPPSRSARKNKDQGVGSFLVEEEMNSDYLSGDGSSRSADSRKHFSNKVASTQNASAGPIHKRSSRTASSGYANRRNPPENPLAQSVPSFSDLRKENTKPSPGVSRVSARVQQKSFARSKSIIEESKSILKEDQSRRSQSMRKNQIPDELKDISSGNDDIYNWAPSRISKNQSEGPFAYSTRRSGPPKPFLRKGNGTHPVIGIAGFQAAAAMMANALQHGDSGDFEDQQEDSPDDAKEEEEYESMEENLRESDFPADSDSENPRVSHEFGNSDDPGSENGDADFPSKTPAIGSTKFTAFTGNVHNPAGDVPAPWSSRLPQLFPYTNDNSDGDAFADSPSGSPSPWNSHSLDEITDADVSRMRKKWGSAQMPFAGVNAPQQPRKDVSKGLKKLWKFGRKTRGGDGLVNDWVSASTASECDDDMEDGRDLVVGSSDDFRKSRMGYLASYDGFVENEVFSEQEQSLRSSIPNPPANFRLREDQLTGSSLKAPRSFFSLSTFRSKGGDARLR

SEQ ID NO: 425 - protein, 883 aa, Zea mays
MGPSKGSRTINKIIVKGSEYQQQHDDPSSSSKAKQKRRKLSDFDPKWSKDELTNFYEAYRQYGMDWRKISIAIGTKSSDMVQSLFTLHRTFLSLPEHQATAMGFIALVTGHHNASEKTTTHRGYDHVVRASGKARKHGEKPKSIDGPDLPNCQEAKISGFSDLFQSRYYGVSSELVRYIRNHAVRRRTPRIPAIVSADRSTIDEATPGIENVISSTKRKYEAANNDSAIVPTNKYSPDRVSGFAEAHKAGQDHCLLETIGTGHVATCQQHSKKTRIQQTMEEGQTGVVDHETTMASKEGNKPVDLLNNNQLFIDNISEDDMLVLDVLCSLMNAPSKMPKLEINIPSGSVGKTDSTLSQRREEGHPTIDLSKQGKPVGKSSASKTRKKKYKILDAEVPAVAQNVCGNSLALPETLRVVITDDSSLCTDSGRVGIPEASEDIPAEVPSAQTETKPEVRMSGRTRRKSQMHCKTKHMSCNEGSDNLQAKKLLHCLSSEPLRRWCTYEWFYSAVDYPWFSSNEFVHYLDHAKLSHLSRLTIPEWGTIRSSLGIPRRFSNYFLAVEKENLEDYREKVRKIYAQLSDGSRDFLPADLARPFSIGQQVIVRHPNSRELCDGKVVMMGPDCYKVHFDDPDIGVDIVKDTDCMPVNWLYNRPDNMRSCLSNDAYSILEMDHIPDLTASENEDHAVNGSTVLEGLKSLRLTSDRQPKAESIVNSERPPYRSTSDSPAKSRDCPDNNSAGHYDELESYIAAFAERSLSQARQMVDKAMQANPGGNEDEKVCTSNQVAGCAGPGFEPARGAQLPSDLISNGIATVLSIKSLSDSRHPFANVAGVLDHACSMLRPSCPQNLALYDQIKRDIGIIKTQIFALMPTALGNCSPPVPPM

SEQ ID NO: 426 - protein, 242 aa, Zea mays
MEYVNPLTGFRVDGRRPNEMRQLKGEVGVVARADGSALFEMGNTRVIAAVYGPREVQNKGQQVNSKEALVRCEYRMAEFSTGDRRRKPKGDRRSTEISLVIRQTMEASILTHLMPHSQIDIYVQVLQADGGTRSACINAATLALADAGIPMRDIATSCSAGYLCSTPLLDLNYLEDSAGGSDVTVGILAKMDKVTLLQMDAKLPIDTFENVMGLAIEGCKAIATYIREVLLENTKKLECQRG

SEQ ID NO: 427 - protein, 149 aa, Zea mays
MADQLTDEQIAEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMIREADVDGDGQINYEEFVKVMMAK

SEQ ID NO: 428 - protein, 390 aa, Zea mays
MALIQSLLNHTTLETDTVLFKLVTAVPEQQKQPVQSYDTDIFSRHDQKLLKASAFLPTIESPFVPNSFTGKRKSTVGNSPVVQPHVGSRAVHEYQFLPEQPSDTYERASPHYYDTPVEASNSRIPSLTSGSQLLHGSEEAAPSYAFQGHTSGSSLLPPSSRPQVFPVAPTDYEMTQFNSNLSSVPVEGQFDTSQVAAFEDPPVSSERRAYHDEDTSRVERKRKHNEEAKIAKEVEAHERRIRKELEKQDFLNRKREEQRHKEMERLERERRKEEERLLRERQREEERFQREQRRENERMEKFLQKQSRREEKQRQKEQLRKEKEAARQKAANERAAARRIARDYMELVEDERLELMELAAQNKGLPSMLYLDSDTLQQLDSFREVIFHFK

SEQ ID NO: 429 - protein, 156 aa, Zea mays
MAAFNKLGGLLRHSALVSGITGGSSPAVFNAARLMSTKLFIGGLDWGVDDVKLREAFSSFGEVTEARVITDRETGRSRGFGFVNYSDSDAAKEAISAMDGKEIDGRQVRVNMANERPAGNRGGGGYGGGGYGGGGYGGGGGYGGGGYGGGSQSYDA

SEQ ID NO: 430 - protein, 96 aa, Zea mays
MQINYAYARDTETLFDIISVKVWSLSGYPGNFLQFMYFGINYQSANQSFSFAFFDKHLLARQMNLSIDKRCRINNLSTSMIALSQVLMKVFTFSSI

SEQ ID NO: 431 - protein, 435 aa, Zea mays
MPADVEALVTVVVVAVAAAADDDGATAKLKPLVETAGNDDPDAAEAAAADGTVEEPVANTEAKVGVEAAEDEPKENPGVVTDELPIALVENNEGAGAACEVAKEKPVEDEDAGVVSVVADDENKEGAVFAVVALPDDGVKPNDGAEAVVAGEEENPKDGVVVAADAGEEAVVVLKRGAEVVDPNSDEPVAPPNPKAGADVGVDAVLDAAGPELNEKPNDGAGAAAVVVVEPDADEPKLNPVAPPEKRLGVDAAEEAAPNGLTVAAVEEVAPNGLGVVAAEEVPPNRPEVPPNRLGEVAAEPVADAPKRPGLLAAVEVAPKNPGLLAAEVAAPNKLRVVPAEDAGVAPKRDGADAADEALNREDPKVGAEEAAAEDEEKREEPKAGAGEEADAGWEKEKADGVEEKGEEAVEPAVAELPKPKEVAIAGAGMIWARF

SEQ ID NO: 432 - protein, 142 aa, Zea mays
MGRVRTKTVKKTSRQVIEKYYSRMTLDFHTNKKVLEEVSILPSKRLRNKVAGFSTHLMRRIQRGPVRGISLKLQEEERERRMDFVPEKSALEVEEIRVDKETMEMLAALGMADLPGVERQAEVSNAPAYGRPQYGGPRRDRV

SEQ ID NO: 433 - protein, 202 aa, Zea mays
MTSISSLFISLIPIICDTDGKTFKKPRRPYEKERLDAELKLVGEYGLRCKRELWRVQYALSRIRNAARELLTLDEKNPRRIFEGEALLRRMNRYGLLGEGQNKLDYVLALTVENFLQRRLQTIVFKNGMAKSIHHARVLIRQRHIRVGRQLVNIPSFMVRVDSEKHIDFSLTSPLGGGEPGRVKRKNQKKASGGGGDDEEEE

SEQ ID NO: 434 - protein, 443 aa, Zea mays
MARLVLSECCGLAPLRRLRAGRGAIAAPSPPALSAAPRRRPASASIHRDWALRVSAPTRLASAAVEEDKPSAAPGQEEGAAAGGEFDPGAPPPFGLAEIRAAIPKHCWVKDPWRSMSYVLRDVAVVLGLAAAAARLDSWLVWPLYWAAQGTMFWALFVLGHDCGHGSFSNNPKLNSVVGHILHSSILVPYHGWRISHRTHHQNHGHVEKDESWHPLPERLYKSLDFMTRKLRFTMPFPLLAFPLYLFARSPGKSGSHFNPGSDLFQPTEKNDIITSTASWLAMVGVLAGLTFLMGPVPMLKLYGVPYLVFVAWLDMVTYLHHHGHEDKLPWYRGKEWSYLRGGLTTLDRDYGWINNIHHDIGTHVIHHLFPQIPHYHLIEATEAAKPVLGKYYKEPKKSGALPWHLFRVLAQSLKQDHYVSDTGDVVYYQAESKTSTSALKSD

SEQ ID NO: 435 - protein, 252 aa, Zea mays
MAKNYPTVSAEYSEAVEKARRKLRALIAEKSCAPLMLRLAWHSAGTFDVSSRTGGPFGTMKCPAELAHGANAGLDIAVRLLEPIKEEFPTLSYADFYQLAGVVAVEVTGGPEIPFHPGREDKPQPPPEGRLPDATKGSDHLRQVFGKQMGLSDQDIVALSGGHTLGRCHKERSGFEGAWTTNPLVFDNSYFKELLSGDKEGLLQLPSDKALLSDPVFRPLVEKYAAVCPWSLLSRVWRFIGRQVLIIVCSVG

SEQ ID NO: 436 - protein, 310 aa, Zea mays
MAAAAGGGAVRALSQKEQDIQMMLAADVHLGTKNCDFQMERYAFKRRTDGIYIINLGKTWEKLQLAARVIVAIENPQDIIVQSARPYGQRAVLKFAQYTGAHAIAGRHTPGTFTNQLQTSFSEPRLLILTDPRTDHQPIKESALGNIPTIAFCDTDSPMRYVDIGIPANNKGRNSIGCLFWLLARMVLQMRGTILPGHKWEVMVDLFFYRDPEEAKEQEEEAAVAPEFAAITDYQGADQWGGDQWTSDVTAPPVAPTGADWGAAPAPVPTGDGWDQAGAPAPVVDGTVPPLVAPTGWDQAAPPPTAQGWE

SEQ ID NO: 437 - protein, 654 aa, Zea mays
MKGHQHQQQSSSPLLPMPPPSKRRCSALAAAVPALVVCSTLLPLVYLLALHRPAGYGSDDRAAVVISTELAGLGARGSRHLENGGAMKHKLLKDVSKKVSGSDGVSAERSTRSRFSQDHAAKSKAKLKGAFSLLGLNNDTFKGPRTSKRFQLKDLSWRSKDTTVNGKENHDQETVHEENTKSCEHEYGSYCLWSTEHREVMKDAIVKKLKDQLFMARAHYPSIAKLKQHEAFTRELKQNIQEHERMLSDTITDADLPPFFAKKLEKMEHTIVRAKSSEVGCSNVERKLRQLLDITEDEAYFHTRQSAFLYHLGVQTMPKTHHCLNMRLTVEYFKSGSNHVDQLNDQKLESPALHHYVMFSRNVLAASTTINSTVMNSQDSDHIVFHVFTDAQNFYAMKYWFDKNSYLESTVRVTNIEDNQKLSKDVDSLEMQQLWPTEEYRVTIRNHSEPFQRQMKTKYISIFGLSHFLLPDLLPGLNRVVVLDDDLIVQKDLSPLWNLDMGGKVIGAVQFCGVRLGQLKPYIADHNVDDDSCVWLSGLNVIELDKWRDTGITSLHDQSVQKLRKDSLKSQRLQALPAGLLAFQDLIYPLEDSWVESGLGHDYGISHVDIEKAATLHYNGVMKPWLDLGILDYKNYWRKYMTSGEKFMTECNIH

SEQ ID NO: 438 - protein, 302 aa, Zea mays
MVCMVGNFKMSSVLKLVMMENHATPDMHIFGSKPMADPLDLVCCSTCKKPVKASQYAIHTGQCSSGKVNTNGSVGVDHANPTKPLKKGRKIKLISNGNQKVHIKVKAKSQTESNNIANSFELDNGHVTKVQPIDSTGLGLSADSSATINVPKNHPRDAPVPLATKMYHSQGNYRLRFELGQLYRESCVQHLSGHTTPNVSHENGLMASSRFSSCGNSALPTQKSLVPQTKPLADPQQLAASRPNQSQGTKTDRASAQASAIKNEGSRSRCNKATIPHSRNKGSKKTQQQPNGRVHAIKFPVE

SEQ ID NO: 439 - protein, 97 aa, Zea mays
MDWIEGQLDDESIFPQKLGTPFPPNFKEVVKTIFKRLFRVYAHTYHSHFQKIVSLKEEAHLNTCFKHFILFTNEFGLIDKKELAPLQELIESIIVPY

SEQ ID NO: 440 - protein, 448 aa, Zea mays
MVLQRFSWPYGGRSATFCGSFTGWRECPMGLVGAVFQVVFDLPPGVYQYRFLVDGVWRCDETKPFVRDEYGLISNEVLVENNVQPVVQPEPSIRGTNMDKGTILKTMPPEPSSQNPSMQIAVIRHVVSGILLHNTIYDVVPLSSKLTVLDTQLPVKQAFKIMHDEGLALVPLWDDRQGTITGMLTASDFVLILRKLQRNIQVIGNEEPISAWKEAKLQFYGGPDGAAMQRRPLIHVKDSDNLVDVALTIIRNEISSVPIFKCMADSSGVPFLNLATLQGILKFLCSKLQEEAEGCSLLHNQLLSIPIGTWSPHTGRSSSRQLRTLLLSSPLNTCLDILLQDRVSSIPIVDDNGSLRDVYSLSDIMALAKNDVYARIELEQVTVQNALDVQYQVHGRRQCHTCLQTSTLLEVLEGLSIPGVRRLVVIEQSTRFVEGIISLRDVFTFLLG

SEQ ID NO: 441 - protein, 789 aa, Zea mays
MGCKGSKLDDQEAVALCRARAELLAAAVRHRYALADAHAALADSIDSVAAPLHRLLRLQAQPRGLVLPSARKGGGAPANRLLPRSFDPSSALPAHGHSSQPQFGASPGSEPAPTADSPPRRRRRVPEQLPHPHYAAYGYDYATQPAYAYPAPASSLQFYYARSRPPPASVAVTQRAPGTSERVHFGSFDAAGGYPQHYAYSAQRAQAPPPVAPQRSAPPSPPKASSWDFLNVFENYDSYEHDSYYYDSATAPAAPAAPFMPSRSSREVREEEGIPDLEDDGEEDSVGVVVKEVAGQYSAPGNGGARSRRNSLGGASSTAELDQPENAIAHKDVIGEFRRRPTAHGNVSVHAPPPPARRVVDNASVAGEIKAQLVRTAEAARQLAPMLEVGRPSYQGRSSVYQCSSKMMSAISVAHLGCKDMDVLDVGVVGKMVDTRSLSSALDKLYFWERKLYAEVKAEEKTRLLIAKNSKRLKLLDQKGTEPEKIDETRNLLRKLSTKIRIAVRVIAKISRKINKLRDEELWPQVNALIQGFVLMWQDKLDAYHSQCQVISEAKNFTSVLSGGNGQDLVLELEVELIKWIISFSSWVNSQRNFVKALNGWLALCLNYEPEDNTTGAPSYSPGSIGAPLVFVTCNKWSQAMDRISEKDVVNAMQALVSSVWHLWEQQYLEQSEQIISMREREKWIKILERRTQDINKEADELNKKLALIPSRQRMHVPRRVQLYEAHCVEASNLHINLRLVLEALENFAANSLQAFQDVAKSAEGTRLPRDNVRREHRSSERSSNYKTS

SEQ ID NO: 442 - protein, 137 aa, Zea mays
MVKFLKPGKAVILLQGRFAGRKAVIVRVFEEGTRDRPYGHCLVAGLAKYPKKVIRKDSAKKTAKKSRVKCFIKLVNFTHLMPTRYTLDVDFKDVASGGPDALSTRDKKVEACKAAKARLEERFKTGKNRWFFTKLRF

SEQ ID NO: 443 - DNA, 297 bp, Zea mays
acctgcgccaaggacatccagaaagcagccgccgaagcggccctcgccttccaagacgagacgtgcgatacaaccaccacgaatcatggcctcgatatggaggaaacgatggtcgaagccatctacaccccagagcagtcagaaggcgccttctacatggacgaggaaaccatgttcggcatgccgaccctcctcgacaacatggccgaaggaatgctcctcccacctccctcagttcagtggaaccacaactacgacggcgaaggcgacggagacgtttccctgtggagctactag

SEQ ID NO: 444 - DNA, 444 bp, Zea mays
atgacttgccttgtggccgtcaattctaattctgtaaatagtagtttcaacatcgagtgtggagatgctacagatgccaactttgagaaatacaatctcagtagaggctccgtagctggcattcttacacttgatacagtggcagactatcttccgagaaggggacccctgaagcagagaaggacaggtattgcgtatatagcaaacgtcgcggtgcggaaggaggagcgacggaaagggatcgcgaagatgttggtccaagaagcagaggctcgggcaaggagctggggatgccggtcgatggcactgcactgcgacgtaaacaacgtggccgcgctacgcctgtacagaaaccaaggcttcaagtgcatacgagtgccggaaggagctaaatggcccgaacccaagatagctaaaggagcggagtacaacttcatgatgaag

SEQ ID NO: 445 - DNA, 447 bp, Zea mays
atgaatgacggcgttgatgaacacatgatatggttggtagggttgaagaatatcttcgcccgacagcttcctaatatgcccaaagaatatattgtacgccttgtcatggatagaactcacaagtcaatgatggttatcaggaacaatattgtcgtggggggcattacttatcgcccttatgcaagccagagatttggagaaatagcgttttgtgctatcacagctgatgagcaagttaaaggctatggaacaagattaatgaatcatttgaaacaacatgcacgggatgctgatgggctcacacatttcttaacctatgctgataacaatgctgttggctattttgtaaagcagggtttcacaaaggagatcacattggacaaagaaagatggcaagggtacattaaagattatgacggaggaatattgatggagtgtaaaattgac

SEQ ID NO: 446 - DNA, 1155 bp, Zea mays
atggaggtgggcacgcgcgtgatgtgccggtggcgcgaccagaagctccacccggtcaaggtgatcgagcgccgcaagggctccgcgtgctcttcccccgccgactacgagtattacgtccactacaccgagttcaatagaagacttgacgagtgggttaagcttgatcagcttgatcttgacactgtcgagaccgttgtcgatgagaaagtagaagataaggcaacaagcttaaagatgacacggcaccagaaacgtaaaattgatgaaacacatgtggagcaaggacatgaggagcttgatgcagccagcttgcgggaacatgaagaattcacaaaggtgaaaaatatcgcgaagatcgaactggggagatatgagatagacacatggtatttctctccttttccaccagagtataatgactgcccgaagctgtttttctgtgaattttgcctcaacttcatgaagcgcaaagaacagcttcagaggcacatgaagaagtgtgatcttaagcaccccccaggtgatgaaatctatagaagtggaactctatcaatgttcgaggttgatgggaagaagaacaaggtttatggacagaacctttgttatctggctaagctatttcttgatcacaagacattgtactatgatgttgatttgttcttgttttatgtcctctgcgaatgtgatgatcggggatgtcatatggtgggatatttctctaaggaaaaacactccgaagaatcttataatttggcttgcattctcactctccccccataccaaagaaaaggatatgggaagttcctgattgctttctcatatgaactttccaagaaagaaggtaaagttgggacaccggagcgccctctctctgatcttggtctgctcagctatagaggttattggactagagtgcttctggaaattctaaagaaacataagggaaacatatctataaaggaactaagcgacatgacggcaataaaagcagatgacatattgagcacgctacagagcctggacctaatccagtaccgcaaagggcagcacgtcatctgcgctgacccgaaggtcctcgaccgccacctcaaggcggcggggcggggcggcctggacgtcgacgttagcaagctcatatggactccctacaag

SEQ ID NO: 447 - DNA, 1371 bp, Zea mays
atgatggcgctcaagcagaaggacaccgacgccgccgccaccgccaccggtaccaagaagcgccgccgcgtcttcttctccgacaccgatgctggtgttgaggcaaatgagtgtatgaaagtgtttctagtatggaatccaggcgaggtgagctctgtagactgcactgctattcagccatttgacctaaaccatttttttggtgaagatggaaaaatatatggttacaaaaatcttaagataaatgtgtggataagtgcgaaatctttccatggatatgctgatgtttcatttgacgaaacatctgatggagggaaaggaataacagatctaaagcctgttcttcagaacatttttggagaaaacttggtagaaaaagaggaattcctgcatacattttcgaaggaatgtgaatatatcagaactgcagtgacaaatggtagtgccattaagcatgatggctcatatgaatcagatcctgcagttgagattgttcgagttgaactccaaggtgctgctgcatttctttattctcgtctggtacctcttgttcttcttctggttgaaggttccacgcctatagatattggagaacatggatgggaaatgcttctggtagtaaagaaggcaacacaagaggctggttcaaaatttgaactgctaggttttgcagctgtgcataacttctatcattatcctgagagtattcgcttacgaatcagccagatacttgtgttgccaccttatcagggtgaaggccatggtcttggtcttcttgaagcaatcaattatattgcacagtctgagaacatttacgatgttacaatagaaagcccttctgattacctgcagtatgtgcgatcatccattgactgcctccgtttgctcatgtttgatccgatcaaacctgcactcggtgctattgtcttgtctctgaaggagaccaacctgtcaaaaagggcccaaagtttgagaatggttccaccagctgacctgatggagactgtccgtcagaagctgaagataaacaagaaacagttcctccggtgctgggaaattctgatcttcctaagcctcgactctcaggatcataagagcatggacaacttcagggcctgcatatatgaccgcatgaagggggagatccttggcagtgcctctggaactaacaggaagcgtctgttgcagatgccaaccagtttcaataaggaggcatcttttgctgtgtattggacacaggagattgaggatgaggatgaacaaactgttgagcagcagccagaggatctcaagacgcaggagcaacagctcaatgagctcgtggacatccaaatcgaggagattgctggggtcgccaagaacgtcacttca

SEQ ID NO: 448 - DNA, 177 bp, Zea mays
gtggcctttcaaatactaaatgaaaagacaactgtcttgtctcctgaagtgcttctttctgctggagttccttgctgcagattggttcaaaaccctggtgaatttgttatcacattccctggagcttatcattctggttttagccatggatttaattgtggagaagcaacaaacatt

SEQ ID NO: 449 - protein, 98 aa, Zea mays
TCAKDIQKAAAEAALAFQDETCDTTTTNHGLDMEETMVEAIYTPEQSEGAFYMDEETMFGMPTLLDNMAEGMLLPPPSVQWNHNYDGEGDGDVSLWSY

SEQ ID NO: 450 - protein, 148 aa, Zea mays
MTCLVAVNSNSVNSSFNIECGDATDANFEKYNLSRGSVAGILTLDTVADYLPRRGPLKQRRTGIAYIANVAVRKEERRKGIAKMLVQEAEARARSWGCRSMALHCDVNNVAALRLYRNQGFKCIRVPEGAKWPEPKIAKGAEYNFMMK

SEQ ID NO: 451 - protein, 149 aa, Zea mays
MNDGVDEHMIWLVGLKNIFARQLPNMPKEYIVRLVMDRTHKSMMVIRNNIVVGGITYRPYASQRFGEIAFCAITADEQVKGYGTRLMNHLKQHARDADGLTHFLTYADNNAVGYFVKQGFTKEITLDKERWQGYIKDYDGGILMECKID

SEQ ID NO: 452 - protein, 385 aa, Zea mays
MEVGTRVMCRWRDQKLHPVKVIERRKGSACSSPADYEYYVHYTEFNRRLDEWVKLDQLDLDTVETVVDEKVEDKATSLKMTRHQKRKIDETHVEQGHEELDAASLREHEEFTKVKNIAKIELGRYEIDTWYFSPFPPEYNDCPKLFFCEFCLNFMKRKEQLQRHMKKCDLKHPPGDEIYRSGTLSMFEVDGKKNKVYGQNLCYLAKLFLDHKTLYYDVDLFLFYVLCECDDRGCHMVGYFSKEKHSEESYNLACILTLPPYQRKGYGKFLIAFSYELSKKEGKVGTPERPLSDLGLLSYRGYWTRVLLEILKKHKGNISIKELSDMTAIKADDILSTLQSLDLIQYRKGQHVICADPKVLDRHLKAAGRGGLDVDVSKLIWTPYK

SEQ ID NO: 453 - protein, 457 aa, Zea mays
MMALKQKDTDAAATATGTKKRRRVFFSDTDAGVEANECMKVFLVWNPGEVSSVDCTAIQPFDLNHFFGEDGKIYGYKNLKINVWISAKSFHGYADVSFDETSDGGKGITDLKPVLQNIFGENLVEKEEFLHTFSKECEYIRTAVTNGSAIKHDGSYESDPAVEIVRVELQGAAAFLYSRLVPLVLLLVEGSTPIDIGEHGWEMLLVVKKATQEAGSKFELLGFAAVHNFYHYPESIRLRISQILVLPPYQGEGHGLGLLEAINYIAQSENIYDVTIESPSDYLQYVRSSIDCLRLLMFDPIKPALGAIVLSLKETNLSKRAQSLRMVPPADLMETVRQKLKINKKQFLRCWEILIFLSLDSQDHKSMDNFRACIYDRMKGEILGSASGTNRKRLLQMPTSFNKEASFAVYWTQEIEDEDEQTVEQQPEDLKTQEQQLNELVDIQIEEIAGVAKNVTS

SEQ ID NO: 454 - protein, 59 aa, Zea mays
VAFQILNEKTTVLSPEVLLSAGVPCCRLVQNPGEFVITFPGAYHSGFSHGFNCGEATNI

SEQ ID NO: 455 - DNA, 7527 bp, Zea mays
cctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtgtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggggaggatccagctcccaacagcaacaacagcagcaacagcagcagcagcagcagcaacagcaacagcaacagcagcagcagcagcagcagcaacagcagcaacaaacctgcgccaaggacatccagaaagcagccgccgaagcggccctcgccttccaagacgagacgtgcgatacaaccaccacgaatcatggcctcgatatggaggaaacgatggtcgaagccatctacaccccagagcagtcagaaggcgccttctacatggacgaggaaaccatgttcggcatgccgaccctcctcgacaacatggccgaaggaatgctcctcccacctccctcagttcagtggaaccacaactacgacggcgaaggcgacggagacgtttccctgtggagctactaggcggccgcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 456 - DNA, 7674 bp, Zea mays
cctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtgtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggggaggatccagctcccaacagcaacaacagcagcaacagcagcagcagcagcagcaacagcaacagcaacagcagcagcagcagcagcagcaacagcagcaacaaatgacttgccttgtggccgtcaattctaattctgtaaatagtagtttcaacatcgagtgtggagatgctacagatgccaactttgagaaatacaatctcagtagaggctccgtagctggcattcttacacttgatacagtggcagactatcttccgagaaggggacccctgaagcagagaaggacaggtattgcgtatatagcaaacgtcgcggtgcggaaggaggagcgacggaaagggatcgcgaagatgttggtccaagaagcagaggctcgggcaaggagctggggatgccggtcgatggcactgcactgcgacgtaaacaacgtggccgcgctacgcctgtacagaaaccaaggcttcaagtgcatacgagtgccggaaggagctaaatggcccgaacccaagatagctaaaggagcggagtacaacttcatgatgaaggcggccgcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 457 - DNA, 7677 bp, Zea mays
cctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtgtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggggaggatccagctcccaacagcaacaacagcagcaacagcagcagcagcagcagcaacagcaacagcaacagcagcagcagcagcagcagcaacagcagcaacaaatgaatgacggcgttgatgaacacatgatatggttggtagggttgaagaatatcttcgcccgacagcttcctaatatgcccaaagaatatattgtacgccttgtcatggatagaactcacaagtcaatgatggttatcaggaacaatattgtcgtggggggcattacttatcgcccttatgcaagccagagatttggagaaatagcgttttgtgctatcacagctgatgagcaagttaaaggctatggaacaagattaatgaatcatttgaaacaacatgcacgggatgctgatgggctcacacatttcttaacctatgctgataacaatgctgttggctattttgtaaagcagggtttcacaaaggagatcacattggacaaagaaagatggcaagggtacattaaagattatgacggaggaatattgatggagtgtaaaattgacgcggccgcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 458 - DNA, 8385 bp, Zea mays
cctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtgtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggggaggatccagctcccaacagcaacaacagcagcaacagcagcagcagcagcagcaacagcaacagcaacagcagcagcagcagcagcagcaacagcagcaacaaatggaggtgggcacgcgcgtgatgtgccggtggcgcgaccagaagctccacccggtcaaggtgatcgagcgccgcaagggctccgcgtgctcttcccccgccgactacgagtattacgtccactacaccgagttcaatagaagacttgacgagtgggttaagcttgatcagcttgatcttgacactgtcgagaccgttgtcgatgagaaagtagaagataaggcaacaagcttaaagatgacacggcaccagaaacgtaaaattgatgaaacacatgtggagcaaggacatgaggagcttgatgcagccagcttgcgggaacatgaagaattcacaaaggtgaaaaatatcgcgaagatcgaactggggagatatgagatagacacatggtatttctctccttttccaccagagtataatgactgcccgaagctgtttttctgtgaattttgcctcaacttcatgaagcgcaaagaacagcttcagaggcacatgaagaagtgtgatcttaagcaccccccaggtgatgaaatctatagaagtggaactctatcaatgttcgaggttgatgggaagaagaacaaggtttatggacagaacctttgttatctggctaagctatttcttgatcacaagacattgtactatgatgttgatttgttcttgttttatgtcctctgcgaatgtgatgatcggggatgtcatatggtgggatatttctctaaggaaaaacactccgaagaatcttataatttggcttgcattctcactctccccccataccaaagaaaaggatatgggaagttcctgattgctttctcatatgaactttccaagaaagaaggtaaagttgggacaccggagcgccctctctctgatcttggtctgctcagctatagaggttattggactagagtgcttctggaaattctaaagaaacataagggaaacatatctataaaggaactaagcgacatgacggcaataaaagcagatgacatattgagcacgctacagagcctggacctaatccagtaccgcaaagggcagcacgtcatctgcgctgacccgaaggtcctcgaccgccacctcaaggcggcggggcggggcggcctggacgtcgacgttagcaagctcatatggactccctacaaggcggccgcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 459 - DNA, 8601 bp, Zea mays
cctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtgtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggggaggatccagctcccaacagcaacaacagcagcaacagcagcagcagcagcagcaacagcaacagcaacagcagcagcagcagcagcagcaacagcagcaacaaatgatggcgctcaagcagaaggacaccgacgccgccgccaccgccaccggtaccaagaagcgccgccgcgtcttcttctccgacaccgatgctggtgttgaggcaaatgagtgtatgaaagtgtttctagtatggaatccaggcgaggtgagctctgtagactgcactgctattcagccatttgacctaaaccatttttttggtgaagatggaaaaatatatggttacaaaaatcttaagataaatgtgtggataagtgcgaaatctttccatggatatgctgatgtttcatttgacgaaacatctgatggagggaaaggaataacagatctaaagcctgttcttcagaacatttttggagaaaacttggtagaaaaagaggaattcctgcatacattttcgaaggaatgtgaatatatcagaactgcagtgacaaatggtagtgccattaagcatgatggctcatatgaatcagatcctgcagttgagattgttcgagttgaactccaaggtgctgctgcatttctttattctcgtctggtacctcttgttcttcttctggttgaaggttccacgcctatagatattggagaacatggatgggaaatgcttctggtagtaaagaaggcaacacaagaggctggttcaaaatttgaactgctaggttttgcagctgtgcataacttctatcattatcctgagagtattcgcttacgaatcagccagatacttgtgttgccaccttatcagggtgaaggccatggtcttggtcttcttgaagcaatcaattatattgcacagtctgagaacatttacgatgttacaatagaaagcccttctgattacctgcagtatgtgcgatcatccattgactgcctccgtttgctcatgtttgatccgatcaaacctgcactcggtgctattgtcttgtctctgaaggagaccaacctgtcaaaaagggcccaaagtttgagaatggttccaccagctgacctgatggagactgtccgtcagaagctgaagataaacaagaaacagttcctccggtgctgggaaattctgatcttcctaagcctcgactctcaggatcataagagcatggacaacttcagggcctgcatatatgaccgcatgaagggggagatccttggcagtgcctctggaactaacaggaagcgtctgttgcagatgccaaccagtttcaataaggaggcatcttttgctgtgtattggacacaggagattgaggatgaggatgaacaaactgttgagcagcagccagaggatctcaagacgcaggagcaacagctcaatgagctcgtggacatccaaatcgaggagattgctggggtcgccaagaacgtcacttcagcggccgcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 460 - DNA, 7407 bp, Zea mays
cctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtgtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggggaggatccagctcccaacagcaacaacagcagcaacagcagcagcagcagcagcaacagcaacagcaacagcagcagcagcagcagcagcaacagcagcaacaagtggcctttcaaatactaaatgaaaagacaactgtcttgtctcctgaagtgcttctttctgctggagttccttgctgcagattggttcaaaaccctggtgaatttgttatcacattccctggagcttatcattctggttttagccatggatttaattgtggagaagcaacaaacattgcggccgcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 461 - protein, 1501 aa, Zea mays
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSSSQQQQQQQQQQQQQQQQQQQQQQQQQQQQQQTCAKDIQKAAAEAALAFQDETCDTTTTNHGLDMEETMVEAIYTPEQSEGAFYMDEETMFGMPTLLDNMAEGMLLPPPSVQWNHNYDGEGDGDVSLWSY

SEQ ID NO: 462 - protein, 1551 aa, Zea mays
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSSSQQQQQQQQQQQQQQQQQQQQQQQQQQQQQQMTCLVAVNSNSVNSSFNIECGDATDANFEKYNLSRGSVAGILTLDTVADYLPRRGPLKQRRTGIAYIANVAVRKEERRKGIAKMLVQEAEARARSWGCRSMALHCDVNNVAALRLYRNQGFKCIRVPEGAKWPEPKIAKGAEYNFMMK

SEQ ID NO: 463 - protein, 3104 aa, Zea mays
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSSSQQQQQQQQQQQQQQQQQQQQQQQQQQQQQQMNDGVDEHMIWLVGLKNIFARQLPNMPKEYIVRLVMDRTHKSMMVIRNNIVVGGITYRPYASQRFGEIAFCAITADEQVKGYGTRLMNHLKQHARDADGLTHFLTYADNNAVGYFVKQGFTKEITLDKERWQGYIKDYDGGILMECKIDMDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSSSQQQQQQQQQQQQQQQQQQQQQQQQQQQQQQMNDGVDEHMIWLVGLKNIFARQLPNMPKEYIVRLVMDRTHKSMMVIRNNIVVGGITYRPYASQRFGEIAFCAITADEQVKGYGTRLMNHLKQHARDADGLTHFLTYADNNAVGYFVKQGFTKEITLDKERWQGYIKDYDGGILMECKID

SEQ ID NO: 464 - protein, 1788 aa, Zea mays
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSSSQQQQQQQQQQQQQQQQQQQQQQQQQQQQQQMEVGTRVMCRWRDQKLHPVKVIERRKGSACSSPADYEYYVHYTEFNRRLDEWVKLDQLDLDTVETVVDEKVEDKATSLKMTRHQKRKIDETHVEQGHEELDAASLREHEEFTKVKNIAKIELGRYEIDTWYFSPFPPEYNDCPKLFFCEFCLNFMKRKEQLQRHMKKCDLKHPPGDEIYRSGTLSMFEVDGKKNKVYGQNLCYLAKLFLDHKTLYYDVDLFLFYVLCECDDRGCHMVGYFSKEKHSEESYNLACILTLPPYQRKGYGKFLIAFSYELSKKEGKVGTPERPLSDLGLLSYRGYWTRVLLEILKKHKGNISIKELSDMTAIKADDILSTLQSLDLIQYRKGQHVICADPKVLDRHLKAAGRGGLDVDVSKLIWTPYK

SEQ ID NO: 465 - protein, 1860 aa, Zea mays
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSSSQQQQQQQQQQQQQQQQQQQQQQQQQQQQQQMMALKQKDTDAAATATGTKKRRRVFFSDTDAGVEANECMKVFLVWNPGEVSSVDCTAIQPFDLNHFFGEDGKIYGYKNLKINVWISAKSFHGYADVSFDETSDGGKGITDLKPVLQNIFGENLVEKEEFLHTFSKECEYIRTAVTNGSAIKHDGSYESDPAVEIVRVELQGAAAFLYSRLVPLVLLLVEGSTPIDIGEHGWEMLLVVKKATQEAGSKFELLGFAAVHNFYHYPESIRLRISQILVLPPYQGEGHGLGLLEAINYIAQSENIYDVTIESPSDYLQYVRSSIDCLRLLMFDPIKPALGAIVLSLKETNLSKRAQSLRMVPPADLMETVRQKLKINKKQFLRCWEILIFLSLDSQDHKSMDNFRACIYDRMKGEILGSASGTNRKRLLQMPTSFNKEASFAVYWTQEIEDEDEQTVEQQPEDLKTQEQQLNELVDIQIEEIAGVAKNVTS

SEQ ID NO: 466 - protein, 1462 aa, Zea mays
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSSSQQQQQQQQQQQQQQQQQQQQQQQQQQQQQQVAFQILNEKTTVLSPEVLLSAGVPCCRLVQNPGEFVITFPGAYHSGFSHGFNCGEATNI

SEQ ID NO: 467 - DNA, 1635 bp, Candidatus Micrarchaeota archaeon
atgaacatgagtaaaactacgatttcagtaaaattaaagattattgacttaagctctgagaaaaaagagtttcttgataactattttaacgaatacgcaaaagccacgacgttctgccagttaagaatacggcgacttttgagaaatacacactggcttgggaaaaaggagaagagttcaaaaaagtggatttttgaaagtggaatatgcgatttgtgcggtgaaaacaaagaacttgtgaatgaagatagaaattcaggcgaacctgcaaaaatttgcaaaagatgttataatggaagatatggcaatcagatgatacgtaaacttttcgtttcaacgaagaaaagagaagttcaggaaaacatggacatacgaagagtcgctaaactaaataatacgcattatcaccgcataccggaagaagcatttgacatgattaaagccgccgatacagcagaaaaaagaagaaagaagaatgtcgagtatgataaaaaaagacagatggaatttattgagatgtttaatgacgaaaaaaaacgtgcggcaagaccaaaaaaaccaaacgaaagggaaacccgttacgttcatatttctaaattggaaagtccgtcaaagggatatactctgaacggaataaaaagaaaaatagacggcatgggtaaaaaaattgagagagcagaaaaaggtctctcaagaaagaagatttttggttatcagggcaatagaatcaaacttgattcgaattgggtccggtttgaccttgccgaatcggagattactatcccctcactgtttaaggaaatgaaactaaggataactggaccgaccaacgttcattcaaaaagcgggcagatatattttgcagaatggtttgagcggataaacaaacaaccgaataattactgttatctgataagaaaaacaagttcgaacggcaaatatgaatattatcttcaatatacttatgaagccgaagttgaggcgaataaggagtacgctgggtgtttgggggttgatataggatgttctaaacttgctgccgcagtttattatgattcaaaaaacaaaaaagcacaaaaaccaattgagatattcacgaatccgattaaaaaaatcaagatgcggcgcgagaaactgattaaacttctttccagagttaaggtgcggcacagacgcagaaaactcatgcaactcagtaaaactgaacccattatagactatacgtgccacaaaaccgcaagaaaaattgttgaaatggcaaatactgccaaagcttttatctcaatggagaatcttgaaactgggataaagcaaaagcaacaggcaagagaaacaaaaaagcagaagttttatcggaatatgtttcttttcagaaaattaagcaaactaatagagtacaaggctctgctgaaagggataaagatagtatatgtgaaacccgattatacaagccaaacttgttcttcatgtggcgcagacaaagaaaaaaccgagcgcccatcacaagcaatatttcgctgtcttaatccaacatgccgatattatcaaagagacataaatgccgacttcaacgccgcagtgaatatagctaagaaagctttaaataatactgaagtagtaactacgttattatga

SEQ ID NO: 468 - DNA, 1761 bp, Candidatus Micrarchaeota archaeon
atgccatccgaaacatacattacgaaaaccttgtcattaaaactcattccatcagatgaagaaaagcaggcgttagaaaactattttataacattccagagggccgtgaattttgctatagatagaatagtagatataagaagctcctttagatatctaaacaaaaatgaacaatttccagccgtgtgtgattgctgtggtaagaaagaaaagataatgtatgtgaatatatccaataaaacctttaagtttaaaccatcaagaaatcagaaggatagatacacgaaggacatttatacaatcaagcccaatgcccacatatgtaagacatgctacagtggcgttgcaggaaatatgtttatacgcaaacaaatgtatccgaacgataaagaagggtggaaagtttcgcgttcatacaatatcaaagttaatgcccctggactgactggaaccgaatatgctatggccatacggaaggcaataagtatattaagatcttttgaaaagcgacgaagaaatgctgaaagaagaatcatagagtatgaaaagtccaaaaaagagtatttagaattgattgatgatgttgaaaaaggaaagacaaataaaatagtggttcttgagaaagaaggccatcagcgagtgaaaagatataaacacaagaattggcctgagaaatggcaaggtatttctttaaataaagcaaaaagtaaggttaaagatattgagaaaagaataaaaaagctcaaggagtggaaacaccctacactaaatcgaccatatgtcgagttacacaaaaataatgttaggatagtgggttatgaaacagtggaacttaaattaggaaacaaaatgtacaccatacattttgctagcatatctaatttacgaaaaccatttagaaaacaaaagaaaaagtccatagaatatctgaaacatctcctaaccctagcgttaaaaagaaatcttgaaacataccccagcataataaaaagaggtaagaatttctttttgcagtatcctgtgcgagtgacagttaaagtgcctaagctgacaaaaaattttaaagcttttggcatcgatagaggcgtaaataggcttgcagtaggttgtataatctcaaaagatggaaaacttaccaataaaaatatttttttcttccatggaaaggaagcgtgggccaaggaaaacagatacaagaagattagggacagattatacgctatggccaagaagttgagaggagataaaaccaagaaaataaggctttatcatgagattaggaagaaatttagacataaagtcaaatatttcaggagaaactatctgcataatatctctaagcaaattgttgagattgcaaaggaaaatacaccgactgtcatcgtattagaagatttacggtacttgagagaaaggacatatagaggaaaaggaagaagcaaaaaggcgaaaaaaacaaattataaattaaatacttttacttacagaatgcttatagatatgataaaatacaaggcagaagaagcgggagttcctgtaatgattattgacccaagaaacacatcacgaaaatgttctaagtgtggttatgttgacgaaaataatagaaaacaagcctcgtttaagtgccttaagtgtggttatagtcttaatgcagacttaaatgcagctgtcaatatagcaaaagctttttatgaatgccccacgtttagatgggaagaaaaattgcatgcatatgtttgttcagagcccgataaatag

SEQ ID NO: 469 - DNA, 1812 bp, Candidatus Aureabacteria bacterium
atgaagtcatttaagctaaagttgttgccaacagatgagcaaaacgttcttttaaatgaagtgttttgtaaatgggcatcattatgtaccagaatggcgtctaaaggacacgataaagaacgactggcgcctcctgattcaagcgggaattattttaacaaaacacaactcaatcaggtgaatactgatgtaactgaccatatgggtgcgcttgaagagtcagcaagtcaaaaagaaagagcagttgagaaagtcaaaagaaggttgaagctgatttcagatatgctctctgagccaaatttaagggatgtttctcaacaaaaaccaaccacgttccgtccattagagtgggttaaggagggtctgttaaaaacaaaataccatactgtgcattattggcaaaaggaatgtgataagttaacaaaacaaaaagaacgaatggagaaaacaattgagaagataaagaaagggaagataacgttcaaaccaacaaagatgtccctgcaccaaaattgtttttcgttatcattcggaaagggaacgttttcaatgcggccttttagcgacactaaacgaggcataaatcttgatatgctaactgctcccattcaacctgcaataggaaaaaacgatggcaaatcatctttgaggagcaaagagtttatcgcaaggaatattgaaaactacattattttttccatccactcacaactatttgggctgagcaggtcagaagaactgttgttaaacgcaaaaaaagaggaactcgttgctaagcgagatgcaatgctcaaaaagaaatctgattcgctaagtaaaaaaataaaggaattagaaaaaatagtaggaagaaaaattactgattcagaacgttcagagataatgtctcagggcggcaaattgtcttctgaaaagttcagtgaagataattcatatttgaaaacgttaaaggtgctggcaaaagacattattgggcgagaggaattgttcagacttaagaagtacccgattgtgattagaaaacctctcaacgaacgaaaaaagctcaaaaatcttaaacctgacgaatgggaatattatttacagttgagttatgatgagttggaaaagaaagagtttacaccaaagacaattatgggaatcgatagaggactaaaacacattcttgctattgcgatttacgaccctgtgcaaaataaatttgtaaaaaatatgctcattccaaatccgatattaggttggaagtggaagttgcgaaagataaaaagaagtattcaacatatggaaaggagaatacgggctcagcaaaatgctcacgttcctgagaatcagttgaaaaaacggttgaaaagtattgagaacaaaattgattattactatcacaatgtgtcgcggcaaatattgaatctcgctcacgatttcaaatcagcaatagtggtagaagacttacagaatatgaaacaacacggaagaaagaaatcaaaaggactaagaggactaaactacgcattaagtaactttgactatggaaaaattatgggtcttgttaagtataaagcagaatcagagaatgtgcctcttcttaccgtgttgcctgcaggaacgagtcaaaattgcgcgtattgtctcttgtacggaaaagaacaaggaaattatgtgcggaataatgtcaacagtaaaataggcaagtgtaagcttcatggagaaatagatgcggacatcaatgcggcaaggacgattgcgatttgttatcataagaatattaatgaaccaaaaccatatggtgaacgaaagacttttaaaagaaagtaa

SEQ ID NO: 470 - DNA, 1590 bp, Uncultured bacterium
atggctaagaatactattacaaaaactctgaaactgagaatagttcgaccatataattctgctgaagtagagaagatagtagctgatgagaaaaacaatagggagaaaatcgccttagaaaaaaataaggataaggttaaagaggcctgtagcaagcatctcaaagttgccgcctattgcacgacgcaagtagaaagaaatgcatgccttttctgcaaagcaagaaaattagacgataagttctaccaaaagctgaggggacaatttcctgatgctgtattttggcaagagatttctgagatattcaggcaattgcagaagcaagctgctgaaatatataatcaaagtctcatcgaactatattacgagatttttataaagggaaaaggaattgcaaatgcttcatcagttgagcattatctcagtgatgtttgttatacaagagctgccgaattattcaaaaatgctgcgatagcaagcggtttaagatcaaagataaagagcaatttcaggctcaaggaattaaaaaatatgaaatcagggcttccgactacaaaatcagacaacttccccattcctcttgtcaagcagaaaggagggcaatataccggctttgagatttcaaatcataattctgatttcatcataaaaattccgtttggcagatggcaagtgaaaaaagagattgataaatacaggccttgggaaaagtttgattttgaacaagtgcagaagtctcctaaacccatctctctcttgctgtccacgcagagaagaaaaagaaacaaagggtggtccaaagatgagggtactgaggcagaaataaagaaagtgatgaatggagattaccaaacaagctatattgaggtaaaaagaggatcgaaaattggggagaagagtgcttggatgcttaatctttctatcgatgtccccaagatcgacaagggagttgatccgtccattataggcggaatcgatgtcggcgtgaaaagcccgcttgtgtgcgctatcaacaatgctttcagtcgttactctatctcggacaatgacctctttcatttcaacaaaaaaatgttcgccagaaggaggatattgcttaagaagaataggcataaaagagcaggacatggtgctaaaaataaacttaagcctatcaccatattaactgaaaaaagcgagagatttaggaagaaactaatcgagaggtgggcgtgcgagattgcagattttttcatcaaaaataaggttggaactgtccaaatggaaaatttggagtccatgaagagaaaagaagacagctacttcaacatcagattgagaggtttttggccttatgcagaaatgcaaaataaaatagaatttaagctcaaacagtatggtatagaaataagaaaagtagcgcctaacaatacctctaaaacgtgctccaaatgtggtcaccttaataactattttaattttgaatacagaaaaaagaacaaatttcctcatttcaagtgtgaaaagtgcaatttcaaggaaaatgcggattataacgccgctttaaatatttccaatccaaaactaaaatcaacaaaggaagaaccatag

SEQ ID NO: 471 - DNA, 1842 bp, Candidatus Micrarchaeota archaeon
atgatttcactcaaacttaaactgcttccagacgaagaacaaaagaaattgcttgacgaaatgttttggaagtgggcctcgatttgtacccgcgttggttttgggcgggctgataaagaagatttaaaaccgccaaaagacgcggaaggggtttggtttagtttaacacaattaaatcaagccaacacagacattaacgacttaagggaggcgatgaagcaccaaaaacaccgcctagaatacgaaaaaaaccgtttggaagcgcaaagagatgatactcaggatgccttgaaaaatccggacagacgagaaataagcactaaaagaaaggatttattccgtcccaaagcgtccgtcgaaaaaggctttctgaaactgaagtatcatcaagagcgttattgggttcgaaggctgaaagaaataaacaaactaattgaaaggaaaacgaagacacttataaaaatagaaaaggggcgaatcaaattcaaggcaacgcgaataaccctgcaccaaggctcttttaaaattagattcggcgataaacccgcttttctgataaaggcgttgtctggaaaaaaccaaatagacgctccttttgttgtagtgccagaacaaccaatctgcgggagcgttgtaaatagcaagaaatacttagatgaaattactactaatttcttggcttacagcgtaaatgcaatgcttttcggtttgagccgcagcgaggaaatgttgttgaaagccaaaaggccagaaaaaatcaagaaaaaagaagaaaaacttgctaaaaaacaatcagcctttgaaaacaaaaagaaggaattgcaaaaattacttggtagagaactaacccagcaggaagaagcgattattgaagaaacccgcaaccaattctttcaagattttgaggtgaaaataaccaaacaatactcggaattactcagcaaaattgctaacgaactcaagcaaaaaaatgattttctgaaagtaaacaaatatcctatacttttaaggaaacctctcaagaaagccaaatcgaaaaaaattaataatctttcgccaagcgaatggaaatattacctccaattcggagttaaacctttactaaaacaaaaatcaagacgaaaatcaaggaatgttttgggaatagaccgcggccttaaacacttgctagccgtaaccgttcttgaacccgacaaaaaaacgtttgtatggaacaaactttacccaaacccaattacgggctggaagtggaggcgacgcaagcttttgcgctccttaaagcgattgaagaggcgcattaaatcgcaaaaacacgaaacaattcatgaaaaccaaacgaggaaaaagctcaagagtttacaaggcaggatagatgacctgcttcataatatttccagaaaaatagtggagaccgcaaaagaatatgatgcggtaatagtagtggaagacctccaaagcatgcggcaacacggtcgttcaaaaggcaatcgtttgaaaacactgaattacgcgctaagccttttcgattacgcaaacgtgatgcaacttataaagtacaaggcgggtatagaaggaatccaaatatatgacgttaaaccagctggcacaagccaaaattgcgcgtattgccttttagcgcaaagggattcacacgaatacaaaagaagccaagaaaactccaaaataggtgtttgcttaaatcctaactgccaaaaccacaagaaacaaattgacgctgacctaaacgcggcaagagtaatagctagttgttacgccttaaaaattaatgattcccaaccatttggaacaaggaaaagatttaaaaaaagaacaacgaattaa

SEQ ID NO: 472 - DNA, 1503 bp, Uncultured bacterium
atggaagtacaaaaaactgtgatgaagacactttctttgagaatattaagacctctgtactcacaagaaatagaaaaagagattaaagaagaaaaagaaagaagaaaacaagccggaggaactggagagcttgacgggggattttataaaaagcttgagaagaagcattcagagatgttcagctttgataggttaaacttattgttgaatcaattacaaagagaaattgctaaggtctacaatcatgccatcagtgaattgtatatagcgactatcgctcaaggtaacaagagcaacaaacattatattagtagtattgtctataatcgagcatatggatacttttataacgcttacatagccttagggatatgttcaaaagttgaagcaaattttagatccaatgaactcctaacacaacaaagcgcattgcctacagcaaagtcagataattttccaatagttttacataaacaaaaaggtgctgagggagaggatggaggatttaggatatctactgaggggagcgatctgatatttgagatacccattccgttctatgaatataatggggagaaccgaaaagaaccctataaatgggttaaaaaaggaggacaaaaacctgtgttaaaacttatactttctacttttaggagacaaagaaataaggggtgggcaaaagacgagggcacggatgcggaaataagaaaggttacagaagggaagtatcaagtcagccaaatagaaataaataggggtaaaaaactaggagaacatcaaaaatggtttgccaatttcagcatagagcaaccaatttatgaaagaaaacctaatcggagtattgtcggcggattagacgtgggaataagatcccccctagtatgtgcaattaacaactcattttcgagatattctgttgattccaatgatgtatttaagttttctaaacaagtattcgcatttagaagacggctattatcgaaaaactctttgaaaaggaaaggtcatggggcggctcataagttagaacctatcacggaaatgacagaaaaaaatgacaagtttagaaagaaaataattgagagatgggccaaggaagttacaaatttctttgttaaaaaccaagtaggaattgttcagatagaagatttatcaacgatgaaagacagagaggatcatttttttaatcaatatcttagaggattttggccttattaccaaatgcagacattaattgagaacaagctcaaagagtatgggattgaggtaaaaagggtacaggcaaaatatacgtctcagttgtgctcaaaccctaattgcaggtattggaataactattttaactttgaataccgaaaagtaaataaattcccaaaatttaaatgtgaaaagtgtaacttagaaataagtgctgactataacgctgctcgcaatctatcaactcccgatatagagaaatttgtggcaaaagctacaaaaggcattaatttgccagaaaaatga

SEQ ID NO: 473 - DNA, 1275 bp, Parageobacillus thermoglucosidasius
atgaagtatacgaaagtaatgaggtatcaaattatcaaacccttaaacgcagaatgggatgaattgggaatggttctccgtgacatccagaaagaaactcgcgcggcattaaacaagacgattcaattgtgttgggaatatcaaggatttagtgcggattataagcagatacacggtcagtatcctaaaccaaaagatgttttaggatacacaagtatgcacggatatgcttatgatcgtctcaaaaatgaattcagcaaaattgcaagttcaaacctttcgcaaactatcaaacgagcggtagataaatggaatagtgacttaaaagaaattctgcgtggtgaccgctccatccctaacttcagaaaagattgtccaattgatatcgttaagcaatcgacgaaaatacaaaaatgtaatgatggatacgtattaagcctcggtttaattaatagagagtataaaaatgaattgggacggaaaaacggagtatttgatgtacttataaaagcaaacgataaaacccagcaaaccatattagaacgaattataaatggcgattatacatatacggcatctcaaataatcaatcataaaaataagtggtttattaaccttacctatcaatttgaaactaaagaaacagccttagatcccaataatgtcatgggagttgatctaggaattgtttatcctgtttatatagcatttaataacagtcttcaccgttatcatattaaaggaggagaaatagaacgattcagacggcaagtagaaaaaaggaagagggaattgttaaatcaaggcaaatattgtggagacgggcgtaaagggcatggttatgctacaagaacaaagtccattgaatcaattagcgataaaattgcgagatttcgtgacacttgcaatcataaatattccaggtttattgtagatatggcgcttaaacataattgtgggataattcaaatggaagatttgactggaattagcaaggaaagtacatttttgaaaaattggacatattacgatcttcagcagaaaatcgaatataaggcacgagaagcaggaatacaagttataaaaattgaaccccaatatacatctcaacgttgtagtaaatgtggctatattgataaagagaatcggcaagaacaagctacatttaagtgcatcgaatgtggttttaagacaaatgctgactataatgcagcaaggaatatcgcaataccgaacattgacaagataataaggaaaacgttaaaaatgcaataa

SEQ ID NO: 474 - DNA, 1269 bp, Acidibacillus sulfuroxidans
atgatcaaagtatatcggtatgagatcgtaaaaccgcttgatttagattggaaagagtttggaactattttacgacagttacaacaggaaactcgttttgccttaaacaaagcgactcaactggcttgggaatggatgggctttagtagtgattataaggataatcatggggaatatccaaaaagtaaagacattctcggatacacgaatgttcacggatacgcttaccatacgatcaaaaccaaagcatatcgcttaaacagtggtaatttatctcaaaccatcaaacgtgcgacggatcgttttaaagcatatcaaaaggaaatcttacgtggcgatatgtccattccgtcctataaacgagatattccactcgatctgattaaagagaatatcagcgtaaatcgtatgaatcacggggattatatcgcttcgttatctctgttaagcaatccagccaagcaagaaatgaatgtaaagaggaaaatttcggtcataatcattgtccgtggcgcagggaaaacaatcatggacagaatcctaagtggtgaataccaagtctctgcttcacaaataattcacgatgatcgaaaaaacaaatggtatttaaacataagttatgattttgaaccccaaacccgagtgttggatctaaataaaataatggggattgatttaggcgttgctgttgccgtttacatggcatttcaacatacccctgctcgatacaaattggagggaggtgagattgaaaattttcgtagacaggtagaatctcgacggattagtatgttacgtcaaggtaaatatgccggtggtgcccgtggagggcatgggcgagataaaagaataaaaccgattgaacagcttcgagataaaattgctaattttagagataccacaaaccatcgttatagtagatatatagtggatatggcaattaaagaaggttgtggaacgattcagatggaggatttaacgaatatacgcgatattggatctcgatttttacaaaattggacctattatgatttgcagcaaaaaattatttataaagccgaagaggcaggaattaaagtcataaagatcgatccccaatataccagtcaacgttgtagtgaatgtggtaatatagattccgggaatcgaattggacaagctatctttaaatgcagagcttgcggatacgaagccaatgcagactacaatgctgcacgaaacatagcaataccgaacattgacaaaattatagctgagagtatcaaataa

SEQ ID NO: 475 - DNA, 1323 bp, Ruminococcus sp
ctggtcaaagtcgtaaaaatccatctaattagtgagcaatttgacaaagcaggcaaccggatagattatgaagaagtcaataaaatactgtgggaattgcaaaagcagacacgagaagcaaagaataaaactgttcagcttctttgggaatggaacaatttttcaagcgattatgttaaggcgagtggcatatatcctaaagcaaaagacatatttggctactcaagtgtgcatggacaagcaaacaaagaattaagaacaaaactcgctttaaattcaagtaatctttccactaccacaatggacgtatgtaaaaattttaatacatataaaaaagaggtatggaaaggcaaacgatcagttccttcgtacaaatcagaccaacctcttgatctgcacaaagactctataaagctgatatatgaaaacaacgaattttatgttaggctcgctttattaaaaaaagctgaatttgcaaagtatggttttaaagacggttttcgttttaaaatgcaggtgaaagataattctaccaaaactattcttgaacgctgttttgacgaagtatacaaaataaatgccagcaaacttttatatgaccaaaagaaaaagaagtggaagcttaatctgtcttatagtttcgacaataaaaacatttctgaacttgacaaagaaaagatccttggtgttgatgtaggcgttaactgtcctttagtcgcttcggttttcggcgatcgtgaccgattcataatcaagggcggcgaaattgaaaaattcagaaaaagcgtggaagctcgcagacgttcaatgctcgagcaaacaaaatactgcggtgacggaagaattggtcacggcagaaaaaaacgcactgagcctgccctaaatataggcgacaagatagcaagatttcgtgatacaacaaaccacaaatacagcagagctttgatagaatatgctgtaaaaaagggctgcggaactatccaaatggaaaagctgacgggtattacatctaaatctgatcgttttctaaaagactggacttattatgacctccagacaaagatagaaaacaaggcgaaagaagtagggataaatgtcgtctatatcgcccctaaatatacaagtcagagatgtagcaaatgcggatatatccacaaggataacagaccaaatcaggcgaaatttagatgtcttgaatgcgattttgaaagtaatgcagattataatgcaagtcagaatatcggaattaaaaacattgataagataatagaaaaagatttgcaaaagcaagaaagcgaagtccaagtgaacgaaaacaagtag

SEQ ID NO: 476 - DNA, 1494 bp, Syntrophomonas palmitatica
atgggcgaatcggtaaaagcaataaaattaaagatactggatatgtttttagaccccgaatgcacaaagcaggatgataactggcgcaaagatttgtctactatgtccagattctgcgctgaagcggggaatatgtgtctgcgcgacctgtataattacttttcaatgcccaaggaagaccgtatttcctcaaaagacttatataacgctatgtatcataaaactaaacttctccatcctgaattaccaggtaaggtagcgaaccaaatagtaaaccacgctaaagatgtttggaaacgcaacgctaaactcatttatcggaaccaaatctcaatgcctacatataagataacaacagcaccaatccggctgcaaaataacatttataaattaataaaaaataagaacaaatacataatagacgtacagttatactccaaggaatactccaaggatagtggtaaaggcactcataggtattttctggtagcagttagagactcatcaacccgtatgatattcgaccgtattatgagtaaggaccatattgacagtagtaaatcatacacgcaaggacaactccaaatcaagaaagaccaccaggggaaatggtattgcatcataccctatacattccctacacatgagacagtcctcgaccctgataaagtcatgggagtagaccttggcgttgcaaaagctgtttactgggcgtttaatagttcttataaaagaggctgtatcgacggtggggaaatagaacatttccgcaaaatgatacgagctcgcagggtgtccatccaaaatcaaatcaaacattcaggggacgcccgtaaaggacatgggcgcaaaagggcgttaaaacccatagaaacattgagcgagaaggaaaagaattttagggatacaataaaccaccgctatgcaaatcgaattgtagaagctgctattaagcaaggctgtgggacaatccaaatcgaaaaccttgaaggtatagctgacacaacaggcagtaaatttctcaagaactggccttattacgacctgcagacaaaaattgttaataaagccaaggaacatggcattaccgttgttgcaataaacccccaatatacatcccaaaggtgttcgatgtgcgggtatattgaaaaaaccaaccgttcatcacaggcagtatttgaatgtaaacaatgcggttacggcagtaggactatatgtattaactgcaggcacgtccaagtatccggggatgtttgtgaggaatgtggcggcatagtaaaaaaagaaaacgtaaacgcagactacaatgcggcaaaaaacatatccacaccgtacatcgaccagataataatggagaagtgtttagaactaggtattccttaccgcagtataacctgtaaagaatgtggtcacatacaggcttcaggaaatacctgcgaggtttgcggaagtactaatattttgaaaccaaagaaaattagaaaagcaaaataa

SEQ ID NO: 477 - DNA, 1494 bp, Clostridium novyi
atgattacagttagaaaaataaagttaacaataatgggagataaagatacaagaaatagtcaatacaaatggattagagatgaacaatacaatcagtacagagctttaaatatgggtatgacttatttagctgtaaatgatattttatatatgaatgaaagcggattagaaattcgaactattaaagatttaaaagattgtgaaaaagatattgataaaaataaaaaagaaattgaaaagttaactgcaagactagagaaggaacaaaataagaaaaattcctcatcagaaaaattagatgagattaaatataaaataagtttagtagaaaataaaattgaagattataaattaaaaatagttgagttaaataaaattcttgaagaaacacaaaaagaaagaatggatatacagaaagaatttaaagaaaaatatgtagatgatctttatcaagttttagataaaataccctttaagcatttagacaataaaagtctagttactcaaagaataaaagctgatataaagtcagataaaagtaatggactattaaaaggtgaaagaagtattagaaactacaagagaaactttcctttaatgactagaggacgagatttaaaatttaaatatgatgataatgatgatattgaaataaagtggatggaaggaattaaatttaaagttattttgggaaatagaataaaaaattccttagagcttagacacactttacataaagttatagagggaaaatataaaatatgtgatagtagtttgcaatttgataaaaataataatcttatacttaatttaactctagacattcctattgatattgtaaataaaaaagtttcaggaagagttgtaggagtagatttaggattaaagataccagcatattgtgcattaaatgatgttgaatatattaaaaaatctataggacgtatagatgatttcttgaaagttagaactcaaatgcagagtagaagaagaagacttcaaattgcaatacaaagtgctaaaggtggaaaaggtagggtgaataaacttcaagccttggagagatttgctgaaaaggagaagaattttgcaaagacatataatcattttttaagttctaatatagttaaatttgcagttagcaatcaggccgaacaaattaatatggagttattaagtttaaaagaaactcaaaataagtcaatactaagaaattggagttattatcaacttcaaacaatgattgagtataaagcccaacgtgaagggattaaagttaagtacatagatccttatcatacatcacaaacatgtagtaaatgtggtaattatgaagaaggacaaagagaatctcaagctgattttatatgcaaaaaatgtggttataaagttaatgctgattataatgcagctagaaatatcgctatgagtaataaatatataacaaaaaaagaagaaagtaagtattacaaaattaaagaaagtatggtataa

SEQ ID NO: 478 - protein, 544 aa, Candidatus Micrarchaeota archaeon
MNMSKTTISVKLKIIDLSSEKKEFLDNYFNEYAKATTFCQLRIRRLLRNTHWLGKKEKSSKKWIFESGICDLCGENKELVNEDRNSGEPAKICKRCYNGRYGNQMIRKLFVSTKKREVQENMDIRRVAKLNNTHYHRIPEEAFDMIKAADTAEKRRKKNVEYDKKRQMEFIEMFNDEKKRAARPKKPNERETRYVHISKLESPSKGYTLNGIKRKIDGMGKKIERAEKGLSRKKIFGYQGNRIKLDSNWVRFDLAESEITIPSLFKEMKLRITGPTNVHSKSGQIYFAEWFERINKQPNNYCYLIRKTSSNGKYEYYLQYTYEAEVEANKEYAGCLGVDIGCSKLAAAVYYDSKNKKAQKPIEIFTNPIKKIKMRREKLIKLLSRVKVRHRRRKLMQLSKTEPIIDYTCHKTARKIVEMANTAKAFISMENLETGIKQKQQARETKKQKFYRNMFLFRKLSKLIEYKALLKGIKIVYVKPDYTSQTCSSCGADKEKTERPSQAIFRCLNPTCRYYQRDINADFNAAVNIAKKALNNTEVVTTLL

SEQ ID NO: 479 - protein, 586 aa, Candidatus Micrarchaeota archaeon
MPSETYITKTLSLKLIPSDEEKQALENYFITFQRAVNFAIDRIVDIRSSFRYLNKNEQFPAVCDCCGKKEKIMYVNISNKTFKFKPSRNQKDRYTKDIYTIKPNAHICKTCYSGVAGNMFIRKQMYPNDKEGWKVSRSYNIKVNAPGLTGTEYAMAIRKAISILRSFEKRRRNAERRIIEYEKSKKEYLELIDDVEKGKTNKIVVLEKEGHQRVKRYKHKNWPEKWQGISLNKAKSKVKDIEKRIKKLKEWKHPTLNRPYVELHKNNVRIVGYETVELKLGNKMYTIHFASISNLRKPFRKQKKKSIEYLKHLLTLALKRNLETYPSIIKRGKNFFLQYPVRVTVKVPKLTKNFKAFGIDRGVNRLAVGCIISKDGKLTNKNIFFFHGKEAWAKENRYKKIRDRLYAMAKKLRGDKTKKIRLYHEIRKKFRHKVKYFRRNYLHNISKQIVEIAKENTPTVIVLEDLRYLRERTYRGKGRSKKAKKTNYKLNTFTYRMLIDMIKYKAEEAGVPVMIIDPRNTSRKCSKCGYVDENNRKQASFKCLKCGYSLNADLNAAVNIAKAFYECPTFRWEEKLHAYVCSEPDK

SEQ ID NO: 480 - protein, 603 aa, Candidatus Aureabacteria bacterium
MKSFKLKLLPTDEQNVLLNEVFCKWASLCTRMASKGHDKERLAPPDSSGNYFNKTQLNQVNTDVTDHMGALEESASQKERAVEKVKRRLKLISDMLSEPNLRDVSQQKPTTFRPLEWVKEGLLKTKYHTVHYWQKECDKLTKQKERMEKTIEKIKKGKITFKPTKMSLHQNCFSLSFGKGTFSMRPFSDTKRGINLDMLTAPIQPAIGKNDGKSSLRSKEFIARNIENYIIFSIHSQLFGLSRSEELLLNAKKEELVAKRDAMLKKKSDSLSKKIKELEKIVGRKITDSERSEIMSQGGKLSSEKFSEDNSYLKTLKVLAKDIIGREELFRLKKYPIVIRKPLNERKKLKNLKPDEWEYYLQLSYDELEKKEFTPKTIMGIDRGLKHILAIAIYDPVQNKFVKNMLIPNPILGWKWKLRKIKRSIQHMERRIRAQQNAHVPENQLKKRLKSIENKIDYYYHNVSRQILNLAHDFKSAIVVEDLQNMKQHGRKKSKGLRGLNYALSNFDYGKIMGLVKYKAESENVPLLTVLPAGTSQNCAYCLLYGKEQGNYVRNNVNSKIGKCKLHGEIDADINAARTIAICYHKNINEPKPYGERKTFKRK

SEQ ID NO: 481 - protein, 529 aa, Uncultured bacterium
MAKNTITKTLKLRIVRPYNSAEVEKIVADEKNNREKIALEKNKDKVKEACSKHLKVAAYCTTQVERNACLFCKARKLDDKFYQKLRGQFPDAVFWQEISEIFRQLQKQAAEIYNQSLIELYYEIFIKGKGIANASSVEHYLSDVCYTRAAELFKNAAIASGLRSKIKSNFRLKELKNMKSGLPTTKSDNFPIPLVKQKGGQYTGFEISNHNSDFIIKIPFGRWQVKKEIDKYRPWEKFDFEQVQKSPKPISLLLSTQRRKRNKGWSKDEGTEAEIKKVMNGDYQTSYIEVKRGSKIGEKSAWMLNLSIDVPKIDKGVDPSIIGGIDVGVKSPLVCAINNAFSRYSISDNDLFHFNKKMFARRRILLKKNRHKRAGHGAKNKLKPITILTEKSERFRKKLIERWACEIADFFIKNKVGTVQMENLESMKRKEDSYFNIRLRGFWPYAEMQNKIEFKLKQYGIEIRKVAPNNTSKTCSKCGHLNNYFNFEYRKKNKFPHFKCEKCNFKENADYNAALNISNPKLKSTKEEP

SEQ ID NO: 482 - protein, 613 aa, Candidatus Micrarchaeota archaeon
MISLKLKLLPDEEQKKLLDEMFWKWASICTRVGFGRADKEDLKPPKDAEGVWFSLTQLNQANTDINDLREAMKHQKHRLEYEKNRLEAQRDDTQDALKNPDRREISTKRKDLFRPKASVEKGFLKLKYHQERYWVRRLKEINKLIERKTKTLIKIEKGRIKFKATRITLHQGSFKIRFGDKPAFLIKALSGKNQIDAPFVVVPEQPICGSVVNSKKYLDEITTNFLAYSVNAMLFGLSRSEEMLLKAKRPEKIKKKEEKLAKKQSAFENKKKELQKLLGRELTQQEEAIIEETRNQFFQDFEVKITKQYSELLSKIANELKQKNDFLKVNKYPILLRKPLKKAKSKKINNLSPSEWKYYLQFGVKPLLKQKSRRKSRNVLGIDRGLKHLLAVTVLEPDKKTFVWNKLYPNPITGWKWRRRKLLRSLKRLKRRIKSQKHETIHENQTRKKLKSLQGRIDDLLHNISRKIVETAKEYDAVIVVEDLQSMRQHGRSKGNRLKTLNYALSLFDYANVMQLIKYKAGIEGIQIYDVKPAGTSQNCAYCLLAQRDSHEYKRSQENSKIGVCLNPNCQNHKKQIDADLNAARVIASCYALKINDSQPFGTRKRFKKRTTN

SEQ ID NO: 483 - protein, 500 aa, Uncultured bacterium
MEVQKTVMKTLSLRILRPLYSQEIEKEIKEEKERRKQAGGTGELDGGFYKKLEKKHSEMFSFDRLNLLLNQLQREIAKVYNHAISELYIATIAQGNKSNKHYISSIVYNRAYGYFYNAYIALGICSKVEANFRSNELLTQQSALPTAKSDNFPIVLHKQKGAEGEDGGFRISTEGSDLIFEIPIPFYEYNGENRKEPYKWVKKGGQKPVLKLILSTFRRQRNKGWAKDEGTDAEIRKVTEGKYQVSQIEINRGKKLGEHQKWFANFSIEQPIYERKPNRSIVGGLDVGIRSPLVCAINNSFSRYSVDSNDVFKFSKQVFAFRRRLLSKNSLKRKGHGAAHKLEPITEMTEKNDKFRKKIIERWAKEVTNFFVKNQVGIVQIEDLSTMKDREDHFFNQYLRGFWPYYQMQTLIENKLKEYGIEVKRVQAKYTSQLCSNPNCRYWNNYFNFEYRKVNKFPKFKCEKCNLEISADYNAARNLSTPDIEKFVAKATKGINLPEK

SEQ ID NO: 484 - protein, 424 aa, Parageobacillus thermoglucosidasius
MKYTKVMRYQIIKPLNAEWDELGMVLRDIQKETRAALNKTIQLCWEYQGFSADYKQIHGQYPKPKDVLGYTSMHGYAYDRLKNEFSKIASSNLSQTIKRAVDKWNSDLKEILRGDRSIPNFRKDCPIDIVKQSTKIQKCNDGYVLSLGLINREYKNELGRKNGVFDVLIKANDKTQQTILERIINGDYTYTASQIINHKNKWFINLTYQFETKETALDPNNVMGVDLGIVYPVYIAFNNSLHRYHIKGGEIERFRRQVEKRKRELLNQGKYCGDGRKGHGYATRTKSIESISDKIARFRDTCNHKYSRFIVDMALKHNCGIIQMEDLTGISKESTFLKNWTYYDLQQKIEYKAREAGIQVIKIEPQYTSQRCSKCGYIDKENRQEQATFKCIECGFKTNADYNAARNIAIPNIDKIIRKTLKMQ

SEQ ID NO: 485 - protein, 422 aa, Acidibacillus sulfuroxidans
MIKVYRYEIVKPLDLDWKEFGTILRQLQQETRFALNKATQLAWEWMGFSSDYKDNHGEYPKSKDILGYTNVHGYAYHTIKTKAYRLNSGNLSQTIKRATDRFKAYQKEILRGDMSIPSYKRDIPLDLIKENISVNRMNHGDYIASLSLLSNPAKQEMNVKRKISVIIIVRGAGKTIMDRILSGEYQVSASQIIHDDRKNKWYLNISYDFEPQTRVLDLNKIMGIDLGVAVAVYMAFQHTPARYKLEGGEIENFRRQVESRRISMLRQGKYAGGARGGHGRDKRIKPIEQLRDKIANFRDTTNHRYSRYIVDMAIKEGCGTIQMEDLTNIRDIGSRFLQNWTYYDLQQKIIYKAEEAGIKVIKIDPQYTSQRCSECGNIDSGNRIGQAIFKCRACGYEANADYNAARNIAIPNIDKIIAESIK

SEQ ID NO: 486 - protein, 440 aa, Ruminococcus sp
MVKVVKIHLISEQFDKAGNRIDYEEVNKILWELQKQTREAKNKTVQLLWEWNNFSSDYVKASGIYPKAKDIFGYSSVHGQANKELRTKLALNSSNLSTTTMDVCKNFNTYKKEVWKGKRSVPSYKSDQPLDLHKDSIKLIYENNEFYVRLALLKKAEFAKYGFKDGFRFKMQVKDNSTKTILERCFDEVYKINASKLLYDQKKKKWKLNLSYSFDNKNISELDKEKILGVDVGVNCPLVASVFGDRDRFIIKGGEIEKFRKSVEARRRSMLEQTKYCGDGRIGHGRKKRTEPALNIGDKIARFRDTTNHKYSRALIEYAVKKGCGTIQMEKLTGITSKSDRFLKDWTYYDLQTKIENKAKEVGINVVYIAPKYTSQRCSKCGYIHKDNRPNQAKFRCLECDFESNADYNASQNIGIKNIDKIIEKDLQKQESEVQVNENK

SEQ ID NO: 487 - protein, 497 aa, Syntrophomonas palmitatica
MGESVKAIKLKILDMFLDPECTKQDDNWRKDLSTMSRFCAEAGNMCLRDLYNYFSMPKEDRISSKDLYNAMYHKTKLLHPELPGKVANQIVNHAKDVWKRNAKLIYRNQISMPTYKITTAPIRLQNNIYKLIKNKNKYIIDVQLYSKEYSKDSGKGTHRYFLVAVRDSSTRMIFDRIMSKDHIDSSKSYTQGQLQIKKDHQGKWYCIIPYTFPTHETVLDPDKVMGVDLGVAKAVYWAFNSSYKRGCIDGGEIEHFRKMIRARRVSIQNQIKHSGDARKGHGRKRALKPIETLSEKEKNFRDTINHRYANRIVEAAIKQGCGTIQIENLEGIADTTGSKFLKNWPYYDLQTKIVNKAKEHGITVVAINPQYTSQRCSMCGYIEKTNRSSQAVFECKQCGYGSRTICINCRHVQVSGDVCEECGGIVKKENVNADYNAAKNISTPYIDQIIMEKCLELGIPYRSITCKECGHIQASGNTCEVCGSTNILKPKKIRKAK

SEQ ID NO: 488 - protein, 497 aa, Clostridium novyi
MITVRKIKLTIMGDKDTRNSQYKWIRDEQYNQYRALNMGMTYLAVNDILYMNESGLEIRTIKDLKDCEKDIDKNKKEIEKLTARLEKEQNKKNSSSEKLDEIKYKISLVENKIEDYKLKIVELNKILEETQKERMDIQKEFKEKYVDDLYQVLDKIPFKHLDNKSLVTQRIKADIKSDKSNGLLKGERSIRNYKRNFPLMTRGRDLKFKYDDNDDIEIKWMEGIKFKVILGNRIKNSLELRHTLHKVIEGKYKICDSSLQFDKNNNLILNLTLDIPIDIVNKKVSGRVVGVDLGLKIPAYCALNDVEYIKKSIGRIDDFLKVRTQMQSRRRRLQIAIQSAKGGKGRVNKLQALERFAEKEKNFAKTYNHFLSSNIVKFAVSNQAEQINMELLSLKETQNKSILRNWSYYQLQTMIEYKAQREGIKVKYIDPYHTSQTCSKCGNYEEGQRESQADFICKKCGYKVNADYNAARNIAMSNKYITKKEESKYYKIKESMV

SEQ ID NO: 489 - DNA, 2000 bp, Zea mays
cgttgagaacaaatctggaaggccatccttgccttctgtcgtcgggcgcaccggacagtccggtgcacaccggacactgtccggtgcccgatttccttccttaaacatcgcagccgaccgttgccaaccgttgcagatctggcgcaccggacagtccggtgcacaccggacagtccggtgccactttccgaccgttggccagaccacgtgtcgcgcgcagatttcgcggccgaccgttggctcgggccgaccgttggctcaccggaaagtccggtgcacaccggacagtccggtgaattttagccgtacgccgtcggcaaattcccgagagcagcgtcttcaggtcgaggcagcctggcgcaccggacactgtccggtgcaccaccggagagtccggtgccccagaccgaagcagtcttttggctgtacacagccaactcttcttctttcttcttctctctgtttctattacttagacaagtatattagtacacaaaaccaatgtactaaggcttagaaacatacctttacttgtgatttgcactttgttcatccatgggcatagatttacatttaagcacttgtgttgacactcaatcaccaaaatacttagaaatggcccaaaggcacatttccctttcagtctttcatcgaacatcatggtcacgttcttcataccataaaaactagcattcccataaacatttgtctccacgcttcctccatggtatagtgtcactagggtgtccatctattgcaaacatggattactaactcaataatggctaaatactagtgcctcaatacttactaagtagtaaataaataataactgcttactatatagtaaatattaaatgaccacattaaccgaaattacataatctatgaataatgtacgaaaacaatgtatacatgagatcgcgtacgagtccagctaacggtggagaaggtcaagtcggaaggacacctatatacaaaaaatactattgtcaataaaaaatcggcagcacctcccctataaagtgatgtttctaaaacctacaaagaaataacaacacgatggttgccaacacagaaaactgctaccaacaagtatatgttaaaccctatataatcactcactttcctccatccattacactaacaatatgctaccgacttactaactatataatcactaactatatacacgaacaaataaatacctagctaactatttataataacaaatgaatagctaacagactatacattaaaccaagtaatcttgtgctacaaatttatttttcagacagaaaaatctatttagctaactaattaatacaaattaataccaagcaacgatagatgaacatctagttgtctaattagctaactaattaatacaaattaagtagaatccttaccgtggggagatggggcgcgacgaagtgctcgagcttggggcgcggcgaccggcgacgtgaagcttgggggcgcgggggccggacggcgctgcgggcggcatggcgggcggctgcgggcggcggcgcgggcgcaggaaacaaacgacgggagtgggaggaaggagaaagcggcgcgccggtttagtcctagctcggcgccaagatctgtggcgccgagctaggtgccacgatggccgccgcgtcagcaaagctcggcgccaaggcatgttgcgccgagccgtgttagctcggcgtcatagctcatggtgccgagttttgggtctaaaattgcgtttaagtattctagggatctaaacgcaaatatttttcgaaaatagggccgaaaaacaaaaaaaaatcggtcgtttcgtcgagcacatcgtccagcctatcttgcatgtccatcctctctatggttcgcgagccgcgcgcatggcgctccaaaggaggggcgaggttgaatatagacagatggaatgggtggttctctatttatagcgcatgcagtcgtcccctggcacacctatttatatgtgagcgttcctggcacta

SEQ ID NO: 490 - DNA, 99 bp, Zea mays
gagagatcgatcgatcgagcttaattgcgccactgctcgttatcctcctcttgcattgcattgcaggtcgtagttgagcagcagcaaccactgcacagg

SEQ ID NO: 491 - DNA, 2000 bp, Zea mays
caaccaatcaggatttctttgtagggtcgagagaaggaggaagtactctccatgccatgcacgccacagtattgaatgtttttggcatggtcatactagccgtgtgtctctgttccatttggccagccagctccaattatttggcatgatcatcctgtcatactagcagtagcagcgtcatcttcgccgctggccgccccctgcaggctgcagtgtcacacatgcctaatcctgcagtcctgccttttgccttccaaaccgtgtgagccttccgtgcgctcgtcaagtttatgggctgtatttttccgagaggagcctaatgggccaaaagcaaggccttttgggccaatcacgatgggccttaggacactttctaaggcaagaacatgaacctttttctttttctcatattgtcatctgcgtattgtttcatgaagttgctatgcaacgtcacctgaagttgtaaccaactccacgtcacctgaagttgtaaccaactccacgcatataatattggtcctattttgcagagcgtaggttctgttggatctacctgatcaatagttagcggctagtgtaaataaaatagatcctatgatccatctaagtttgaattttcatgtttaataatcagtatgtgactatttaaactaatcttatttgctaatgttttttcgatatagtttaaaggctgtagaatatacttgaacttaggcaaagtggtgaccgagatgatcaacacatcaatcaagacgttagaagccttgatgaaacattcacgagagacgagcaaggagtctaagacgctaagataaataaaacctagaccaaggcatgtggagaaataaagtcaaacaaatgctactcgacaacatccagcttgtccagtactgcaccagaccagcccagagacaaaaagttcaaaagcatgtaaaaagaacgcaacggtaacacaccagatgtgtccggtgctatgccctatgacataaccaacgccacaatgtgcacgatgtgctctagaatgtgaggccagacgcatccggtggcacaacgaacactttactcatctagggttatagagtggattgcaacatgacttggagatgacgacaacttaccgaacgtcacatttgacgacagatctccaatggccaataactgctggaaagccaatagatacgtcacatggacgcaccaaacgtgtttggtgtctatgtaaaatttgttgtgtatccccacgaccacatttacattgggggctatatatacccccttgctagccaaatagagggtggtagagtatgttgaaattgtaggagagtgtcaagacacttcatcaagtgctctaaccacacaaaaaacacttaacaaaagattagatgagcagcatagtgatttttgtgaattgcttatgctagttaaacacatttatttacccttgttgtaggttagggcctagtgtttagtgttgtttgcatagcgctcttaccactcatacactatttttgtacaccaggggcctgaagtcttacaccaatcgtgtttatggtgtgttcgtcaccgtgtgctaaaggaaacgaagcccacaaggaccgattcaggagaagccattttagagacacacttatgtgtagtcaagtcacatgatctattcatagagttattcgacctagagcttgacccttgtacgggaatttatgcgatgagctttaatgaggactaagaaagctaagatacaattaaacttattccgaaaccgacaattaaagacacttcttgggacggagggagtagctgacgttccgtaatgcatgcaagagaagtgaggagggccacgctagagaagagaagtacagaacggaatgagggacggtggcgcatgtccccgcaagatcctgagctgattctaaatcaagcatttgcttgaccaagtctatgcggcgcagagcccgcccgcgccctatgcttgctccggagctctcgttcgttccctgccgcgg

SEQ ID NO: 492 - DNA, 141 bp, Zea mays
cagccatcgatcaccggccccaacgctagctttagcttcgcctatttacatacccgagcggagaagagaagagaagagaagcgatcgggattgtgggcgagtgcgtgcgttcgtgcagccacagacaggcgtccgggcacc

SEQ ID NO: 493 - DNA, 1870 bp, Zea mays
atcttgcaagagcatccggccggatattgctttgcaaagatttgctagctagcagcacatgagatcgagttatgatctccaggtgtactcatgctctccttatgtttggatatactgatcttggatatctatagaagatccccaggtacaagatcaatgacatacttctgcacacttcgtgggattgtacagaatgatatactacatactgaaggtatgtggtggtcatgattttatatcattgaccttattatctataaagataatattacttggtgttgtttagatgaaaaacaagttacaaactaagtctctaccttacttcacattttaaatgtgtttgagagcaggtatgggatgacttagtaatttgcaaagatcagggggagtttcctcttgatcgaaagaacttgtttatacatcatggtgtactcttttctttgcatgagttttcccctgtttgggtttctcattcaaagtttttaacgaggcaacatcaacataaggcctatgtcgtatcatctatttttcccgtagaggttttcgaggatgatacattatggcatagttattgttgtatttgaactaggtgataagtttatctccctagagttcaaatgaatcaacaatagagtatgactactctccttatttctcccactgggtttttaaggagactcagctaatatgttgatttctcagattttctggcaagattatcttggagaaatattagcctgagttatatgtctcatcatttattttccccactggggtttttgagatgatgactatagacatgttattgttctttggtctagaggtccattggagaacaatatcgtaccatggttcaattgaaccaccgacaattatctataaggataattgagcttgtgttgttcagatggaaacaggttatatgaggagcaacatattgctcctaaattgttttatccccatgaacttcaggaaaatgaagatataaacatcttgcaaacaaagtcttgtgataatcttgctgatctattcacaaaatctctaccatactcaacgttttcagaaatgtgttgaggtgattggtatgagaagactcaagtgtttgcaagatcagggggagtaattctccgtgatatttgacctgttttataccatcatattacactcttttctttgtatgagttttgccttgttaaggttttctcatccaaagtttttaacgaggtaatatcaactaagctatatgcttcatcattcactttttcccacaggggtttttatgcatgatgattacaagcatattcttttggagttcaatatgagttttactcataatccaaaagacattgtgtactccttatttttcccacagggtttttgaggagatgatatattggaagacaacttgcagatgatctagtggacttggattgatcaagggggagtgttacaaaatattgtcatgtgatcaaccctctcccctgacagttttctttcaagggacacaccccttgggagacactgtatccacatgtatataaaccagattatctgcaataaagatctacaactgtcatttgtctctctctcaatctcgttactactgagtatactataacaggttcgaccaaaaatagcaaatggtggtctggcttctcgtcatgcatggttttacacgtgtacaggcgagaaagctcatcttaacaaatttaataacccaaatatatatgcatagaaatacccgaccatttgtttgttgagctagcgtgtggctcgcctttggcctcgcctgacctcaccttatatttctaataataccacgtctccctccttatatttaccctcttctcccaagagaaaaatcgggctc

SEQ ID NO: 494 - DNA, 130 bp, Zea mays
caatgcaaacaccagttttctaccctaaacacaagaacccagatgcataataaaaggtgaaagctagcagaagaggtacctaactctaccctactatagagaaaaagtcagcacattgcaagcaataata

SEQ ID NO: 495 - DNA, 1500 bp, Zea mays
ttgatcatttgttcatctcacatgatagttctaacaatatgcacaaattctatacatatctctcgtagttccataaactacgagagagatataggttttatgaacaaatttatttttagtttatcatatgaagaaatgttcaaaatataaaatgtacatcatgatgagttatacaaatttgtagttgaaaactttttcatttgaattaatttactgctttaaaatgtgtatgcagttggcttgatgtgagacaataagctaaaccacgggttttccatgggtttccacccaattacgggttggtttgggatcaataatgttattggatgggttgggtttaactttcctctagtatttttggttgggtgtgggatggatatcaaagtaattagatttgggtatgggtgggagcggattggattttttgccattagcaggcctatgcacttgtcggcgcacacggctggcgcgtgcacacaccttatcggcagacgccgccgctgctgctgctgatgcttcttcttcttccaccgattgattgagatccaaggaaatgctgggcgcgtttttaaactggctgatcggcttcgtcccatgatctgagatttccttttcagactgttgtatatgtagcggcgacatggataggatatgtatggaccgttttaattaatactaaatatcaatggtttaactcttcactattactcctagctagatgtgaaagctcgccctggaatgcacatgaacaactacaccgagttgggcagtttggcaatgcatgcagttcaagagccacgccggttaacccttcactttgtagttattgcctgcattttgtaaatttggtgtgaacttaattctaatctgtaattctgtatagagaatggtgcatgtactgaactcctgactgatcaaaacgtggggtccactttcctcgccgaaaaagaaaagagaaaaaaaggtttattgtccactttattaaaaactggacttatatatatgcttggaacaaatacttagggggtgtttggttttaggaatctctcaatctaaaataaggtggtgtatcataggtttattactcaaatttggtgggatgatctcattgctcatattagtactaactaactaactatgaggaatgagatggtgatggatcaacccattacattctacaaaccaaacaaaaaagtgaggagtgagaagatggtgaactagctcatttctcaaaccaaacactctattaataaaccaatcgcgtagctaataaatatatgtaacctcgacattctagctacagcttgtggttggtagaaaagcaaatcatgctcaaaataatgtgctccgaaacttcattacatttttcttcacttgagtgtacatacattttttttcccttggccctcttatccttaactaagaagcataaaacgggatttctcagccagttcttagcttctcttataaatacagaccttgtacaacactttcacctcc

SEQ ID NO: 496 - DNA, 204 bp, Zea mays
tctcaggtggccaggatattttttctggccccttcctgccctcttcacactgacccatgtgttgttctatccctggaaagctatacctccttacccctatcagcttctcctcacatctcctctcgtcgccacccatgctatcaccgctctgatcacaagcaaggcaaaccctcactgttctatcaacgcccctcccttagctag

SEQ ID NO: 497 - DNA, 3050 bp, Oryza sativa
tgagccaatgggcacagggtcagtgggggtcgcggggccgatgcggagctgacagaagcagggcgagcggttgccgagccgacgagcacatcgacaaagcgggaacggcgggtgtcgatggcgcgggccttgacggagatgcagccaccctttcctcgttcacctcggacaccactgttgacggcgccgcatcgctggcctgcttccagcggccgagatctgaaggaggctgtagagggagaagaaggaaaggggaggggctgacgggtgggatccacattgctttccacacgggcatgctacatagataaaagtgacaaatagttaaaaaattatctctctccagtagcaaattattaagcgtgaatctaaaatggacatttgtataactgtttaccaacatgtacggtttgcgagttgggacgcaatgtggccagaataccagaccaaataagtgaggagctgtttggtttacatggacttatttcaagtccctgtctcatcggatgtttggacactaatttagagtattaaacatacattaattacaaaacccatttcataagtttggattaattcgcgagacgaatcttttgagtctaattacgccatgattttgacaatgtgatgctacagtaaacttttgataattatggattaactaggcttaaaaaaatcgtctcgcggattagctctcatttataaaattagttttttattagtctatatttaatactctaaattagcgtccaaacatccgatgtgacatgggctaaaaagttttagccccatctaaacaccccctgaatcgtttgattctagggttgtgtttagttccttataaagttagaagtttgggttaaaattggtacgatgtgactgaaaagttatgtatatgatagattgatgtgatggaaaaagttagaagtttggatccagcctaggtagccgtcggtcgtccatccggagtggtgggcgtcaggctagcttcggccagcggagggcattttggccgccgccgacgcttcggccggcgtatcaacggcctcgcggtaaaagaggtggcccaattcaatttcgtcttctcaactttactgaacaactcctctccacccgtcccaactactcttcctttgtttctaacaacaattttcaaagaagaaatcaattgagaaataactagaatttcgtattcttcgtatgtttttgttcaagagttgggattgatcgagttgagttaaaatgaatgtttggtctaaagacatgtgaaataagatgatttttaactctttaattttctctcttgttcacgtttgagccatcccttaaaagtagaaccatcgtatccctcatgccaaacgaatatactagcagtatgggtctaacccatctcactttcttcctaaaccaaacatatatatatatgattagttacgtcattttaaatataagacgtaaccttttttttatgttttataatacgaggcgtgcatatttttaatcttattgaatatatgtattatatttattagagtgatctaagcgtggaggtaataataattttttttttgtctttgcattaggtagactgatagtctgcttatattttgtgatgaaggcagtataattcattggcttaattagattaaagcaagaattgacactatccatttttggaattaaattagcaagatacttatttaacatactccaaaatatgcacaacttcaaatttattaattatgaagttttaaaatattataatctggaaaactaaagcgtaggctcgaagtttagtacaactatgtatatactaattttggattcaaactttatttttttttctatcaaaagattaagactccacaccaaatacaacaaactttataattaaaataatttaaataactcatgaaatacaataactgcaaatggagtacaaatttgtatttattattaatttgagaaaacaactaaacttaagatttgatgaatttattactaatttgagaaaacaactaaaattaagatttgatgaatacattttttactcgttaatcataaatttcagaactgttatattataggaaactacgtactctcttggtcctaacaaatattattgttaaactcggtttttgacttggtcctaacaaatattattgttaaactcggtttttgacttctagtttattttttaattttgcgtctatgtattcttataatctaaatataatgtaaactatttaagctgaaattaagaaaatacagctacgaagctccccaaacatgctccgatgcccgtagtttgcgttggccggtgaagcaattaaggtggagtttggatacagggactttaactttagtctctgtatttggatattaatttaaagtattaaatatagactacttacaaaactaattacataaataaaagctaatttgcgagtcaaattttttaagcctatttaatatacaattagagaatatttaatgtagcattatatagactaatcatggattaattaggctcaataaatttgtctcgcgaattagtttaagattatagatgagttttattaatagtctacgtttaatatttataattagtatcaaaacatccgatatgatagttacttaaaaagttttaaaaaggtataaacaccttgcatggcatgcacttcaacctaaaatcgatgtcaattttacttttaaaaaaacttgtactaaaatcaaagcagcgcggcgtgtcgcaggggcatcagtaataatcaccatcccgctcgtgcgcgcgcgttcataccgcatgcatttgcatgcacacacacgcgtagcactagtactctctctctctctctgtgttgataaccccaatacaaatgcagggcttctctctctacctctgctatttgctgagactagaaaggaagagtctatctagggcttgctgcccataaagacgacaagaaccacctctctctctctctctcactgtccacatctctccaacaagagaaatactttacacacttgcagcaactcttccccag

SEQ ID NO: 498 - DNA, 27689 bp, Artificial Sequence
  RP000001
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatctgcggttaccgaattcgagctcggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtaagtttctgcttctacctttgatatatatataataattatcattaattagtagtaatataatatttcaaatatttttttcaaaataaaagaatgtagtatatagcaattgcttttctgtagtttataacttcgtatagcatacattatacgaagttatacttttctaatatatgaccaaaatttgttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccgggatctgagtcgaaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagatcgatgggccctggccgaagcttggtcacccggtccgggcctagaaggccagcttcaagtttgtaccctggagcttgccgagtgccatccttggacactcgataaagtatattttattttttttattttgccaaccaaactttttgtggtatgttcctacactatgtagatctacatgtaccattttggcacaattacatatttacaaaaatgttttctataaatattagatttagttcgtttatttgaatttcttcggaaaattcacatttaaactgcaagtcactcgaaacatggaaaaccgtgcatgcaaaataaatgatatgcatgttatctagcacaagttacgaccgatttcagaagcagaccagaatcttcaagcaccatgctcactaaacatgaccgtgaacttgttatctagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtactcgacaaagaagccgttgtcgatgtactgttcgtcgagatctctttgtcgagtgtcacactaggcaaagtctttacggagtgtttttcaggctttgacactcggcaaagcgctcgattccagtagtgacagtaatttgcatcaaaaatagctgagagatttaggccccgtttcaatctcacgggataaagtttagcttcctgctaaactttagctatatgaattgaagtgctaaagtttagtttcaattaccaccattagctctcctgtttagattacaaatggctaaaagtagctaaaaaatagctgctaaagtttatctcgcgagattgaaacagggccttaaaatgagtcaactaatagaccaactaattattagctattagtcgttagcttctttaatctaagctaaaaccaactaatagcttatttgttgaattacaattagctcaacggaattctctgtttttctaaaaaaaaactgcccctctcttacagcaaattgtccgctgcccgtcgtccagatacaatgaacgtacctagtaggaactcttttacacgctcggtcgctcgccgcggatcggagtccccggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaaggatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgagctagacccagctttcttgtacaaagtggccgttaacggatccagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcaagctgttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccatttcaaatatttttttcaaaataaaagaatgtagtatatagcaattgcttttctgtagtttataacttcgtatagcatacattatacgaagttatacttttctaatatatgaccaaaatttgttgatgtgcaggtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgatgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacataaagctttccactggttgccatatatgatttgggcatttcactttgatcttaatgggccttgtaaagcccaagactcatgattatctttagttgatgctcttaattaggtgtgggcaaataattcaaactgtatgtacccgaccaaaaccaaagcaaaaataatcgaaccaaaccgaaaatttaaaaataaccgaatgaaaactaaatcctataactgaaagaactgaaaccgaatcaaaatatttaatgtaaccaaaaatatccgaaatataattatattgtcaaaaatattaataatttctagattaaataattaaaaatacttaaaaatttatataaaatagtaaaaatactcgaaaataaccacaaatattcaaaaacaaccgaaatatcccaaaatattcaaagcaaaataaccgaatggataccaaattttaaaaccgaaaaaactggaacaaaaccaaaatcgaaccaaaatttcaaaaatcgaataaatactaaactttagaacaaaaaaaaacgataaccgaatgtatacgaaccaaagccgaattagataaccgaacgtccaggactactcttaatctttccgccacttatgatttgggctattactttgtttataatgagccttttcaagctcaagttcatgattgtccgtgagatgagaaactgacttgttggattcgaaaccctagctagtattggttaatacttaatacataaatgacctgcattgacatcatcatccaagaaaataaaaattgtatgcttgagatatttagttttcctagctaggttttctttattttagtaccgaatctttaggtgtgccacgttaatttagacccattttttcatacttaccaactgagtctagtttaatcatgactataatcgtataaaatgattcagtcgacgtcattgcgaacgtatataaaatcatccaaattgacgtcattccaaagaggtaagcatgcttatctaagagtccgagcatactaaacaagacgacattttatttgcactccaaatcaaattttgtattgcctaaagaaaaacaatcaaactcaagtttcttaaaattaatttcattcaaactaatcactttcaatatctcacatattattcatgccatttctatttgtctaaacatgatttaaaaaaaaaagtaaaatacaaagattactatgcaaaaactctataaaaaaaaattcaaatttcttatttatttgtgacatcaaattttcaaaataatttttttaattatcggttgatccggtcagtcgataaaaacataaactttcagcgaccgttaaaactttcctactaccgatttagagaaaatcttagcttgaaacgtaattgtaacctgccttcatgcaagtcgcaagatatgtcatcctaagttgtatatgttttctcaaaagatgtatttacttgagaaaatacgtttcaacgttgatggacaaccaattaagaatcaagcacctttcgtaatcaatttaggcttatcgtctaaggtatactgatttacgacagttgactagacttataaggaacaaaataatagaatagtttctaaacacttcacctaatcatagagactaagatggtaattcgtaaacgacaaagcctagtgacactgtccattgtaaaattccacatcatattagtattaaacatatacatgtagtttcctgaacacatgtagtatcaaacacacttcgtggcttcttcctcgaaacctgcggccgctcattaattaagtcatctagttgaaggatcgctatcaactttgtatagaaaagttgggccgaattcgagctcggtacggccagaatggcccggaccgaagcttaccggtcgttgagaacaaatctggaaggccatccttgccttctgtcgtcgggcgcaccggacagtccggtgcacaccggacactgtccggtgcccgatttccttccttaaacatcgcagccgaccgttgccaaccgttgcagatctggcgcaccggacagtccggtgcacaccggacagtccggtgccactttccgaccgttggccagaccacgtgtcgcgcgcagatttcgcggccgaccgttggctcgggccgaccgttggctcaccggaaagtccggtgcacaccggacagtccggtgaattttagccgtacgccgtcggcaaattcccgagagcagcgtcttcaggtcgaggcagcctggcgcaccggacactgtccggtgcaccaccggagagtccggtgccccagaccgaagcagtcttttggctgtacacagccaactcttcttctttcttcttctctctgtttctattacttagacaagtatattagtacacaaaaccaatgtactaaggcttagaaacatacctttacttgtgatttgcactttgttcatccatgggcatagatttacatttaagcacttgtgttgacactcaatcaccaaaatacttagaaatggcccaaaggcacatttccctttcagtctttcatcgaacatcatggtcacgttcttcataccataaaaactagcattcccataaacatttgtctccacgcttcctccatggtatagtgtcactagggtgtccatctattgcaaacatggattactaactcaataatggctaaatactagtgcctcaatacttactaagtagtaaataaataataactgcttactatatagtaaatattaaatgaccacattaaccgaaattacataatctatgaataatgtacgaaaacaatgtatacatgagatcgcgtacgagtccagctaacggtggagaaggtcaagtcggaaggacacctatatacaaaaaatactattgtcaataaaaaatcggcagcacctcccctataaagtgatgtttctaaaacctacaaagaaataacaacacgatggttgccaacacagaaaactgctaccaacaagtatatgttaaaccctatataatcactcactttcctccatccattacactaacaatatgctaccgacttactaactatataatcactaactatatacacgaacaaataaatacctagctaactatttataataacaaatgaatagctaacagactatacattaaaccaagtaatcttgtgctacaaatttatttttcagacagaaaaatctatttagctaactaattaatacaaattaataccaagcaacgatagatgaacatctagttgtctaattagctaactaattaatacaaattaagtagaatccttaccgtggggagatggggcgcgacgaagtgctcgagcttggggcgcggcgaccggcgacgtgaagcttgggggcgcgggggccggacggcgctgcgggcggcatggcgggcggctgcgggcggcggcgcgggcgcaggaaacaaacgacgggagtgggaggaaggagaaagcggcgcgccggtttagtcctagctcggcgccaagatctgtggcgccgagctaggtgccacgatggccgccgcgtcagcaaagctcggcgccaaggcatgttgcgccgagccgtgttagctcggcgtcatagctcatggtgccgagttttgggtctaaaattgcgtttaagtattctagggatctaaacgcaaatatttttcgaaaatagggccgaaaaacaaaaaaaaatcggtcgtttcgtcgagcacatcgtccagcctatcttgcatgtccatcctctctatggttcgcgagccgcgcgcatggcgctccaaaggaggggcgaggttgaatatagacagatggaatgggtggttctctatttatagcgcatgcagtcgtcccctggcacacctatttatatgtgagcgttcctggcactagagagatcgatcgatcgagcttaattgcgccactgctcgttatcctcctcttgcattgcattgcaggtcgtagttgagcagcagcaaccactgcacaggcctaggcgcgccatttaaatatttaaatgcccgggcgatcgctcgaggcgtacctagtggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgggttaccgaattcgagctcggtaccctgggatccgatatcgatgggccctggccgaagcttggtcacccggtccgggcctagaaggccgatctcccgggcacccagctttcttgtacaaagtggccgttaacggatcggccagaatggcccggaccgaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcggccgccccgggcaactttattatacaaagttgatagatcctcatgtcttcatcgtaagcttaaacaggccagaatggcctctggattcagcggcctagaaggccgaagtacttggtcttcctagtcgagtagatcacattcaagcttggtcacccggtccgtcaatattctgattccgatgacttcgtaggttcctagctcaagccgctcgtgtccaagcgtcacttacgattagctaatgattacggcatctaggaccgactagtggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 499 - DNA, 29324 bp, Artificial Sequence
  RP000002
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatctgcggttaccgaattcgagctcggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtaagtttctgcttctacctttgatatatatataataattatcattaattagtagtaatataatatttcaaatatttttttcaaaataaaagaatgtagtatatagcaattgcttttctgtagtttataacttcgtatagcatacattatacgaagttatacttttctaatatatgaccaaaatttgttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccgggatctgagtcgaaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagatcgatgggccctggccgaagcttggtcacccggtccgggcctagaaggccagcttcaagtttgtaccctggagcttgccgagtgccatccttggacactcgataaagtatattttattttttttattttgccaaccaaactttttgtggtatgttcctacactatgtagatctacatgtaccattttggcacaattacatatttacaaaaatgttttctataaatattagatttagttcgtttatttgaatttcttcggaaaattcacatttaaactgcaagtcactcgaaacatggaaaaccgtgcatgcaaaataaatgatatgcatgttatctagcacaagttacgaccgatttcagaagcagaccagaatcttcaagcaccatgctcactaaacatgaccgtgaacttgttatctagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtactcgacaaagaagccgttgtcgatgtactgttcgtcgagatctctttgtcgagtgtcacactaggcaaagtctttacggagtgtttttcaggctttgacactcggcaaagcgctcgattccagtagtgacagtaatttgcatcaaaaatagctgagagatttaggccccgtttcaatctcacgggataaagtttagcttcctgctaaactttagctatatgaattgaagtgctaaagtttagtttcaattaccaccattagctctcctgtttagattacaaatggctaaaagtagctaaaaaatagctgctaaagtttatctcgcgagattgaaacagggccttaaaatgagtcaactaatagaccaactaattattagctattagtcgttagcttctttaatctaagctaaaaccaactaatagcttatttgttgaattacaattagctcaacggaattctctgtttttctaaaaaaaaactgcccctctcttacagcaaattgtccgctgcccgtcgtccagatacaatgaacgtacctagtaggaactcttttacacgctcggtcgctcgccgcggatcggagtccccggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaaggatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgagctagacccagctttcttgtacaaagtggccgttaacggatccagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcaagctgttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccatttcaaatatttttttcaaaataaaagaatgtagtatatagcaattgcttttctgtagtttataacttcgtatagcatacattatacgaagttatacttttctaatatatgaccaaaatttgttgatgtgcaggtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgatgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacataaagctttccactggttgccatatatgatttgggcatttcactttgatcttaatgggccttgtaaagcccaagactcatgattatctttagttgatgctcttaattaggtgtgggcaaataattcaaactgtatgtacccgaccaaaaccaaagcaaaaataatcgaaccaaaccgaaaatttaaaaataaccgaatgaaaactaaatcctataactgaaagaactgaaaccgaatcaaaatatttaatgtaaccaaaaatatccgaaatataattatattgtcaaaaatattaataatttctagattaaataattaaaaatacttaaaaatttatataaaatagtaaaaatactcgaaaataaccacaaatattcaaaaacaaccgaaatatcccaaaatattcaaagcaaaataaccgaatggataccaaattttaaaaccgaaaaaactggaacaaaaccaaaatcgaaccaaaatttcaaaaatcgaataaatactaaactttagaacaaaaaaaaacgataaccgaatgtatacgaaccaaagccgaattagataaccgaacgtccaggactactcttaatctttccgccacttatgatttgggctattactttgtttataatgagccttttcaagctcaagttcatgattgtccgtgagatgagaaactgacttgttggattcgaaaccctagctagtattggttaatacttaatacataaatgacctgcattgacatcatcatccaagaaaataaaaattgtatgcttgagatatttagttttcctagctaggttttctttattttagtaccgaatctttaggtgtgccacgttaatttagacccattttttcatacttaccaactgagtctagtttaatcatgactataatcgtataaaatgattcagtcgacgtcattgcgaacgtatataaaatcatccaaattgacgtcattccaaagaggtaagcatgcttatctaagagtccgagcatactaaacaagacgacattttatttgcactccaaatcaaattttgtattgcctaaagaaaaacaatcaaactcaagtttcttaaaattaatttcattcaaactaatcactttcaatatctcacatattattcatgccatttctatttgtctaaacatgatttaaaaaaaaaagtaaaatacaaagattactatgcaaaaactctataaaaaaaaattcaaatttcttatttatttgtgacatcaaattttcaaaataatttttttaattatcggttgatccggtcagtcgataaaaacataaactttcagcgaccgttaaaactttcctactaccgatttagagaaaatcttagcttgaaacgtaattgtaacctgccttcatgcaagtcgcaagatatgtcatcctaagttgtatatgttttctcaaaagatgtatttacttgagaaaatacgtttcaacgttgatggacaaccaattaagaatcaagcacctttcgtaatcaatttaggcttatcgtctaaggtatactgatttacgacagttgactagacttataaggaacaaaataatagaatagtttctaaacacttcacctaatcatagagactaagatggtaattcgtaaacgacaaagcctagtgacactgtccattgtaaaattccacatcatattagtattaaacatatacatgtagtttcctgaacacatgtagtatcaaacacacttcgtggcttcttcctcgaaacctgcggccgctcattaattaagtcatctagttgaaggatcgctatcaactttgtatagaaaagttgggccgaattcgagctcggtacggccagaatggcccggaccgaagcttaccggtcgttgagaacaaatctggaaggccatccttgccttctgtcgtcgggcgcaccggacagtccggtgcacaccggacactgtccggtgcccgatttccttccttaaacatcgcagccgaccgttgccaaccgttgcagatctggcgcaccggacagtccggtgcacaccggacagtccggtgccactttccgaccgttggccagaccacgtgtcgcgcgcagatttcgcggccgaccgttggctcgggccgaccgttggctcaccggaaagtccggtgcacaccggacagtccggtgaattttagccgtacgccgtcggcaaattcccgagagcagcgtcttcaggtcgaggcagcctggcgcaccggacactgtccggtgcaccaccggagagtccggtgccccagaccgaagcagtcttttggctgtacacagccaactcttcttctttcttcttctctctgtttctattacttagacaagtatattagtacacaaaaccaatgtactaaggcttagaaacatacctttacttgtgatttgcactttgttcatccatgggcatagatttacatttaagcacttgtgttgacactcaatcaccaaaatacttagaaatggcccaaaggcacatttccctttcagtctttcatcgaacatcatggtcacgttcttcataccataaaaactagcattcccataaacatttgtctccacgcttcctccatggtatagtgtcactagggtgtccatctattgcaaacatggattactaactcaataatggctaaatactagtgcctcaatacttactaagtagtaaataaataataactgcttactatatagtaaatattaaatgaccacattaaccgaaattacataatctatgaataatgtacgaaaacaatgtatacatgagatcgcgtacgagtccagctaacggtggagaaggtcaagtcggaaggacacctatatacaaaaaatactattgtcaataaaaaatcggcagcacctcccctataaagtgatgtttctaaaacctacaaagaaataacaacacgatggttgccaacacagaaaactgctaccaacaagtatatgttaaaccctatataatcactcactttcctccatccattacactaacaatatgctaccgacttactaactatataatcactaactatatacacgaacaaataaatacctagctaactatttataataacaaatgaatagctaacagactatacattaaaccaagtaatcttgtgctacaaatttatttttcagacagaaaaatctatttagctaactaattaatacaaattaataccaagcaacgatagatgaacatctagttgtctaattagctaactaattaatacaaattaagtagaatccttaccgtggggagatggggcgcgacgaagtgctcgagcttggggcgcggcgaccggcgacgtgaagcttgggggcgcgggggccggacggcgctgcgggcggcatggcgggcggctgcgggcggcggcgcgggcgcaggaaacaaacgacgggagtgggaggaaggagaaagcggcgcgccggtttagtcctagctcggcgccaagatctgtggcgccgagctaggtgccacgatggccgccgcgtcagcaaagctcggcgccaaggcatgttgcgccgagccgtgttagctcggcgtcatagctcatggtgccgagttttgggtctaaaattgcgtttaagtattctagggatctaaacgcaaatatttttcgaaaatagggccgaaaaacaaaaaaaaatcggtcgtttcgtcgagcacatcgtccagcctatcttgcatgtccatcctctctatggttcgcgagccgcgcgcatggcgctccaaaggaggggcgaggttgaatatagacagatggaatgggtggttctctatttatagcgcatgcagtcgtcccctggcacacctatttatatgtgagcgttcctggcactagagagatcgatcgatcgagcttaattgcgccactgctcgttatcctcctcttgcattgcattgcaggtcgtagttgagcagcagcaaccactgcacaggcctaggcgcgccatttaaatatgctgcatcaggagaacagtgaggctttcgggaggcaccactctgagcagcttgcatgtgtcaacatgaggggagcagataatggtcatccgaatttccttcctgagaaatgccagattgcagtttgtcctgaagttcaccaaaggggtgaaaaagttggactatttgatgaagagctggtacatggtattcatctaaccagtccttgtgttcagtcaccatttttgccaagtggtgtcaaagaaacacctatagtggatcataacaagagacctgcatccagtgacatactggacatagttgaatgcaaacggctgaagcaggaagatcaaatcgttactaaggaagacaaccatacatctgctgaggaggaatttcatgactaccccacatacacgacttgcgaaagaagctttgactcaccactatatgagagtgaggaaagtgaagatgagggcgtagattcacctctccattgttcacatgctcgcacctatgttgaagatggtctatggcctgccagctttcatcaatctgttggccctttttccttgaggaaacctgttcctatcgggtcaaatcatcaggctgaattacctgagtgcaggccatttggtggaagaactgaagaagacgaaagtgtcaagtggatcagaaacagtgttgtgccaatgcctggtactgatgcatcgtctttggtgttggagcctgttcactgcaaagcaggttgtgattgtcttgacgaaggttcaatcaattgtgtgaaaaagcatgtgatggaagcaagagaaaatttgaaggattctgttggtgcagacgccttcagggagttgggtttctatgacatgggggaagaggttgcctcaaggtggtcagaagaggaggaacgtttgttccagcaagtggtctcgtcaaaccgtgcttctctgcgcaggaacttttgggatgaacttcctcttgccttcccttccaagtccagcaaagagctagtgagctactacttcaatgtcttcatgttgaggaagagggctgagcagaacaggttcgacccagcgaacattgacagtgacgacgatgagtggcaggcaggtggtgattttgagtttccaataacaggaagaactgatgaatacatgccaatcgagtcccttactgatcaagatgatgttgcttgcaatccatttcccttggagggggatttatatggagattctgatgatgaggacgagcttgacaattccagtggagacaggcataatggtgtgcagagggctggtatgttgtcagagggtcatcccgaaatgtcatttatagatcatgatcaacagacgttgaagctagatgcagatgcacaagatgactcttgcacatcatttgaggctcatcaggttggttgcgatggtggggcacatactgatattggcaatcactacaggagtgacgacggcctttgtggtggtgcagaacatgggttctttggtgaccattgtgacacaaaagagtggggcttcggtttcagtactggttgggagaggcatgattttttgtcaacgaacaatgtcatagaagaggtgttcgggaagggctccagtgaagatggaagtgacactgctactggccaggaccttatctgaatttaaatgcccgggcgatcgctcgaggcgtacctagtggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgggttaccgaattcgagctcggtaccctgggatccgatatcgatgggccctggccgaagcttggtcacccggtccgggcctagaaggccgatctcccgggcacccagctttcttgtacaaagtggccgttaacggatcggccagaatggcccggaccgaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcggccgccccgggcaactttattatacaaagttgatagatcctcatgtcttcatcgtaagcttaaacaggccagaatggcctctggattcagcggcctagaaggccgaagtacttggtcttcctagtcgagtagatcacattcaagcttggtcacccggtccgtcaatattctgattccgatgacttcgtaggttcctagctcaagccgctcgtgtccaagcgtcacttacgattagctaatgattacggcatctaggaccgactagtggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 500 - DNA, 4119 bp, Artificial Sequence
  dpzm01g012740 paternal parthenogenesis expression cassette
cgttgagaacaaatctggaaggccatccttgccttctgtcgtcgggcgcaccggacagtccggtgcacaccggacactgtccggtgcccgatttccttccttaaacatcgcagccgaccgttgccaaccgttgcagatctggcgcaccggacagtccggtgcacaccggacagtccggtgccactttccgaccgttggccagaccacgtgtcgcgcgcagatttcgcggccgaccgttggctcgggccgaccgttggctcaccggaaagtccggtgcacaccggacagtccggtgaattttagccgtacgccgtcggcaaattcccgagagcagcgtcttcaggtcgaggcagcctggcgcaccggacactgtccggtgcaccaccggagagtccggtgccccagaccgaagcagtcttttggctgtacacagccaactcttcttctttcttcttctctctgtttctattacttagacaagtatattagtacacaaaaccaatgtactaaggcttagaaacatacctttacttgtgatttgcactttgttcatccatgggcatagatttacatttaagcacttgtgttgacactcaatcaccaaaatacttagaaatggcccaaaggcacatttccctttcagtctttcatcgaacatcatggtcacgttcttcataccataaaaactagcattcccataaacatttgtctccacgcttcctccatggtatagtgtcactagggtgtccatctattgcaaacatggattactaactcaataatggctaaatactagtgcctcaatacttactaagtagtaaataaataataactgcttactatatagtaaatattaaatgaccacattaaccgaaattacataatctatgaataatgtacgaaaacaatgtatacatgagatcgcgtacgagtccagctaacggtggagaaggtcaagtcggaaggacacctatatacaaaaaatactattgtcaataaaaaatcggcagcacctcccctataaagtgatgtttctaaaacctacaaagaaataacaacacgatggttgccaacacagaaaactgctaccaacaagtatatgttaaaccctatataatcactcactttcctccatccattacactaacaatatgctaccgacttactaactatataatcactaactatatacacgaacaaataaatacctagctaactatttataataacaaatgaatagctaacagactatacattaaaccaagtaatcttgtgctacaaatttatttttcagacagaaaaatctatttagctaactaattaatacaaattaataccaagcaacgatagatgaacatctagttgtctaattagctaactaattaatacaaattaagtagaatccttaccgtggggagatggggcgcgacgaagtgctcgagcttggggcgcggcgaccggcgacgtgaagcttgggggcgcgggggccggacggcgctgcgggcggcatggcgggcggctgcgggcggcggcgcgggcgcaggaaacaaacgacgggagtgggaggaaggagaaagcggcgcgccggtttagtcctagctcggcgccaagatctgtggcgccgagctaggtgccacgatggccgccgcgtcagcaaagctcggcgccaaggcatgttgcgccgagccgtgttagctcggcgtcatagctcatggtgccgagttttgggtctaaaattgcgtttaagtattctagggatctaaacgcaaatatttttcgaaaatagggccgaaaaacaaaaaaaaatcggtcgtttcgtcgagcacatcgtccagcctatcttgcatgtccatcctctctatggttcgcgagccgcgcgcatggcgctccaaaggaggggcgaggttgaatatagacagatggaatgggtggttctctatttatagcgcatgcagtcgtcccctggcacacctatttatatgtgagcgttcctggcactagagagatcgatcgatcgagcttaattgcgccactgctcgttatcctcctcttgcattgcattgcaggtcgtagttgagcagcagcaaccactgcacaggcctaggcgcgccatttaaatatgctgcatcaggagaacagtgaggctttcgggaggcaccactctgagcagcttgcatgtgtcaacatgaggggagcagataatggtcatccgaatttccttcctgagaaatgccagattgcagtttgtcctgaagttcaccaaaggggtgaaaaagttggactatttgatgaagagctggtacatggtattcatctaaccagtccttgtgttcagtcaccatttttgccaagtggtgtcaaagaaacacctatagtggatcataacaagagacctgcatccagtgacatactggacatagttgaatgcaaacggctgaagcaggaagatcaaatcgttactaaggaagacaaccatacatctgctgaggaggaatttcatgactaccccacatacacgacttgcgaaagaagctttgactcaccactatatgagagtgaggaaagtgaagatgagggcgtagattcacctctccattgttcacatgctcgcacctatgttgaagatggtctatggcctgccagctttcatcaatctgttggccctttttccttgaggaaacctgttcctatcgggtcaaatcatcaggctgaattacctgagtgcaggccatttggtggaagaactgaagaagacgaaagtgtcaagtggatcagaaacagtgttgtgccaatgcctggtactgatgcatcgtctttggtgttggagcctgttcactgcaaagcaggttgtgattgtcttgacgaaggttcaatcaattgtgtgaaaaagcatgtgatggaagcaagagaaaatttgaaggattctgttggtgcagacgccttcagggagttgggtttctatgacatgggggaagaggttgcctcaaggtggtcagaagaggaggaacgtttgttccagcaagtggtctcgtcaaaccgtgcttctctgcgcaggaacttttgggatgaacttcctcttgccttcccttccaagtccagcaaagagctagtgagctactacttcaatgtcttcatgttgaggaagagggctgagcagaacaggttcgacccagcgaacattgacagtgacgacgatgagtggcaggcaggtggtgattttgagtttccaataacaggaagaactgatgaatacatgccaatcgagtcccttactgatcaagatgatgttgcttgcaatccatttcccttggagggggatttatatggagattctgatgatgaggacgagcttgacaattccagtggagacaggcataatggtgtgcagagggctggtatgttgtcagagggtcatcccgaaatgtcatttatagatcatgatcaacagacgttgaagctagatgcagatgcacaagatgactcttgcacatcatttgaggctcatcaggttggttgcgatggtggggcacatactgatattggcaatcactacaggagtgacgacggcctttgtggtggtgcagaacatgggttctttggtgaccattgtgacacaaaagagtggggcttcggtttcagtactggttgggagaggcatgattttttgtcaacgaacaatgtcatagaagaggtgttcgggaagggctccagtgaagatggaagtgacactgctactggccaggaccttatctgaatttaaatgcccgggcgatcgctcgaggcgtacctagtggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 501 - DNA, 3022 bp, Artificial Sequence
  DsRED reporter gene expression cassette
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 502 - DNA, 29998 bp, Artificial Sequence
  RV044486
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatctgcggttaccgaattcgagctcggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtaagtttctgcttctacctttgatatatatataataattatcattaattagtagtaatataatatttcaaatatttttttcaaaataaaagaatgtagtatatagcaattgcttttctgtagtttataacttcgtatagcatacattatacgaagttatacttttctaatatatgaccaaaatttgttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccgggatctgagtcgaaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagatcgatgggccctggccgaagcttggtcacccggtccgggcctagaaggccagcttcaagtttgtaccctggagcttgccgagtgccatccttggacactcgataaagtatattttattttttttattttgccaaccaaactttttgtggtatgttcctacactatgtagatctacatgtaccattttggcacaattacatatttacaaaaatgttttctataaatattagatttagttcgtttatttgaatttcttcggaaaattcacatttaaactgcaagtcactcgaaacatggaaaaccgtgcatgcaaaataaatgatatgcatgttatctagcacaagttacgaccgatttcagaagcagaccagaatcttcaagcaccatgctcactaaacatgaccgtgaacttgttatctagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtactcgacaaagaagccgttgtcgatgtactgttcgtcgagatctctttgtcgagtgtcacactaggcaaagtctttacggagtgtttttcaggctttgacactcggcaaagcgctcgattccagtagtgacagtaatttgcatcaaaaatagctgagagatttaggccccgtttcaatctcacgggataaagtttagcttcctgctaaactttagctatatgaattgaagtgctaaagtttagtttcaattaccaccattagctctcctgtttagattacaaatggctaaaagtagctaaaaaatagctgctaaagtttatctcgcgagattgaaacagggccttaaaatgagtcaactaatagaccaactaattattagctattagtcgttagcttctttaatctaagctaaaaccaactaatagcttatttgttgaattacaattagctcaacggaattctctgtttttctaaaaaaaaactgcccctctcttacagcaaattgtccgctgcccgtcgtccagatacaatgaacgtacctagtaggaactcttttacacgctcggtcgctcgccgcggatcggagtccccggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaaggatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgagctagacccagctttcttgtacaaagtggccgttaacggatccagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcaagctgttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccatttcaaatatttttttcaaaataaaagaatgtagtatatagcaattgcttttctgtagtttataacttcgtatagcatacattatacgaagttatacttttctaatatatgaccaaaatttgttgatgtgcaggtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgatgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacataaagctttccactggttgccatatatgatttgggcatttcactttgatcttaatgggccttgtaaagcccaagactcatgattatctttagttgatgctcttaattaggtgtgggcaaataattcaaactgtatgtacccgaccaaaaccaaagcaaaaataatcgaaccaaaccgaaaatttaaaaataaccgaatgaaaactaaatcctataactgaaagaactgaaaccgaatcaaaatatttaatgtaaccaaaaatatccgaaatataattatattgtcaaaaatattaataatttctagattaaataattaaaaatacttaaaaatttatataaaatagtaaaaatactcgaaaataaccacaaatattcaaaaacaaccgaaatatcccaaaatattcaaagcaaaataaccgaatggataccaaattttaaaaccgaaaaaactggaacaaaaccaaaatcgaaccaaaatttcaaaaatcgaataaatactaaactttagaacaaaaaaaaacgataaccgaatgtatacgaaccaaagccgaattagataaccgaacgtccaggactactcttaatctttccgccacttatgatttgggctattactttgtttataatgagccttttcaagctcaagttcatgattgtccgtgagatgagaaactgacttgttggattcgaaaccctagctagtattggttaatacttaatacataaatgacctgcattgacatcatcatccaagaaaataaaaattgtatgcttgagatatttagttttcctagctaggttttctttattttagtaccgaatctttaggtgtgccacgttaatttagacccattttttcatacttaccaactgagtctagtttaatcatgactataatcgtataaaatgattcagtcgacgtcattgcgaacgtatataaaatcatccaaattgacgtcattccaaagaggtaagcatgcttatctaagagtccgagcatactaaacaagacgacattttatttgcactccaaatcaaattttgtattgcctaaagaaaaacaatcaaactcaagtttcttaaaattaatttcattcaaactaatcactttcaatatctcacatattattcatgccatttctatttgtctaaacatgatttaaaaaaaaaagtaaaatacaaagattactatgcaaaaactctataaaaaaaaattcaaatttcttatttatttgtgacatcaaattttcaaaataatttttttaattatcggttgatccggtcagtcgataaaaacataaactttcagcgaccgttaaaactttcctactaccgatttagagaaaatcttagcttgaaacgtaattgtaacctgccttcatgcaagtcgcaagatatgtcatcctaagttgtatatgttttctcaaaagatgtatttacttgagaaaatacgtttcaacgttgatggacaaccaattaagaatcaagcacctttcgtaatcaatttaggcttatcgtctaaggtatactgatttacgacagttgactagacttataaggaacaaaataatagaatagtttctaaacacttcacctaatcatagagactaagatggtaattcgtaaacgacaaagcctagtgacactgtccattgtaaaattccacatcatattagtattaaacatatacatgtagtttcctgaacacatgtagtatcaaacacacttcgtggcttcttcctcgaaacctgcggccgctcattaattaagtcatctagttgaaggatcgctatcaactttgtatagaaaagttgggccgaattcgagctcggtacggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatggcggagccgaagctggaggacttcctcggcggtggaggcggcagcggtggcggaggctccggaggcggtggcatcgggctgtccatgattaagaactggctgcggagccaaccggcgcccggtggaggcggcagcggtggcggaggctccggaggcggtggcgacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggataaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgggttaccgaattcgagctcggtaccctgggatccgatatcgatgggccctggccgaagcttggtcacccggtccgggcctagaaggccgatctcccgggcacccagctttcttgtacaaagtggccgttaacggatcggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatgggcccatcaaagggttctcgaactattaacaagatcatagtaaaaggatctgaatatcaacagcagcatgatgatccatctagttcaagcaaagctaaacagaaaaggaggaaactctcagactttgatcccaaatggagcaaggatgaacttacaaatttttatgaagcctaccgtcaatatgggatggactggagaaagatcagcatagcgataggcactaagtcatcggacatggtgcagtctcttttcactttacatcggactttcttatctcttccagaacatcaagccactgccatgggatttattgcgctggtgactggtcatcacaatgcttcggagaaaaccacgactcatagaggatatgatcacgtagtcagagcatctggaaaggcaaggaaacatggtgaaaaaccgaaatcaattgatggacctgacctgcccaactgtcaagaagcgaaaatttctggattttcagatttattccagagtcgatactatggcgtttcttcagaattggtcaggtacatccgaaatcatgctgttcggaggcgtactcctcgtataccagctatagtttctgcagacaggagtaccattgatgaggccacaccaggaattgaaaatgtcatcagttctaccaagagaaaatatgaagcagccaataacgactctgctattgtcccaacaaataagtactctcctgacagagtttctggcttcgctgaagcacacaaggctggtcaagatcattgtttgttggagaccataggaactgggcatgtagcgacatgtcaacaacattcaaagaaaacaagaattcagcaaactatggaggaaggtcagactggtgtagttgatcatgagacaacgatggcatctaaagaagggaataagccagttgatttattaaacaacaatcagttatttatcgacaatatttctgaagatgatatgttggtcttggatgtattgtgtagcctgatgaatgcaccctctaaaatgccaaaactagagattaatattccttcaggttcggttggaaaaactgactctacgctatctcagagaagggaggaaggccaccctaccattgatttatctaaacaagggaagccagttggtaaatccagtgcttccaagactaggaagaaaaaatataagatattagacgcagaggtgcctgctgtagcacaaaacgtttgtggtaatagtttagccctgccggaaacactgagggttgttatcactgatgattcttccttgtgtactgactctggaagagtggggataccggaagcatctgaagatattcctgctgaagttcccagtgcacaaacagaaaccaagcctgaagtgagaatgtctggaaggaccagacggaaatctcaaatgcattgcaaaacaaagcatatgtcatgcaatgaaggttcagataatttacaggcaaaaaaattgctgcactgtttgtcatccgaaccacttcgtagatggtgcacatatgagtggttctacagcgcagttgattatccatggttttcaagtaatgagtttgtgcactacttagatcatgcaaaattgagtcatctttcaaggttgactataccagaatggggtacaattcgaagctcccttggtattccacgtcgattttcaaattattttctggccgtggaaaaagaaaatcttgaggattatcgggagaaagttagaaaaatctatgctcaactcagtgatggttcaagggattttctacctgcagacctagctagaccattttcaattggtcagcaagttattgttcgtcatccaaattctagggaactttgtgatggcaaagtggtgatgatgggtccggattgttacaaggttcattttgatgatcctgacattggtgttgatattgtaaaggacactgattgtatgccagtcaactggctgtataaccgtcctgacaacatgaggagctgcctttcaaatgatgcgtacagcatactggagatggatcacattcctgaccttacagcaagtgagaatgaggatcatgctgtaaacggatctactgtacttgaggggctcaaaagtctgcgcttaacatcagatagacaacctaaggcagaatctattgtaaacagtgaaagaccaccatataggagtacatctgacagccctgcaaaatctagagattgcccagacaataatagtgctggccactacgatgagctagagtcatatatagccgcatttgcagaaagatcactatcacaagccaggcagatggttgacaaagccatgcaggcgaaccctggaggtaatgaggatgaaaaggtatgcacgtcaaatcaagtggcaggttgtgcaggcccaggttttgaacctgcccgtggcgcccaacttccttctgacctgatatcgaacggcatcgccacggttctttcaatcaagagccttagcgactcgcgacatccgtttgctaacgtagcaggcgtcttggatcacgcttgctccatgctgcgtccaagctgtccgcagaacctcgctttgtacgatcaaataaagagagacatcggtatcataaagacccagatatttgcacttatgccaacagcattgggcaattgcagccctcctgtcccgcccatgtaaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcggccgccccgggcaactttattatacaaagttgatagatcctcatgtcttcatcgtaagcttaaacaggccagaatggcctctggattcagcggcctagaaggccgaagtacttggtcttcctagtcgagtagatcacattcaagcttggtcacccggtccgtcaatattctgattccgatgacttcgtaggttcctagctcaagccgctcgtgtccaagcgtcacttacgattagctaatgattacggcatctaggaccgactagtggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 503 - DNA, 29275 bp, Artificial Sequence
  RV044827
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatctgcggttaccgaattcgagctcggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtaagtttctgcttctacctttgatatatatataataattatcattaattagtagtaatataatatttcaaatatttttttcaaaataaaagaatgtagtatatagcaattgcttttctgtagtttataacttcgtatagcatacattatacgaagttatacttttctaatatatgaccaaaatttgttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccgggatctgagtcgaaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagatcgatgggccctggccgaagcttggtcacccggtccgggcctagaaggccagcttcaagtttgtaccctggagcttgccgagtgccatccttggacactcgataaagtatattttattttttttattttgccaaccaaactttttgtggtatgttcctacactatgtagatctacatgtaccattttggcacaattacatatttacaaaaatgttttctataaatattagatttagttcgtttatttgaatttcttcggaaaattcacatttaaactgcaagtcactcgaaacatggaaaaccgtgcatgcaaaataaatgatatgcatgttatctagcacaagttacgaccgatttcagaagcagaccagaatcttcaagcaccatgctcactaaacatgaccgtgaacttgttatctagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtactcgacaaagaagccgttgtcgatgtactgttcgtcgagatctctttgtcgagtgtcacactaggcaaagtctttacggagtgtttttcaggctttgacactcggcaaagcgctcgattccagtagtgacagtaatttgcatcaaaaatagctgagagatttaggccccgtttcaatctcacgggataaagtttagcttcctgctaaactttagctatatgaattgaagtgctaaagtttagtttcaattaccaccattagctctcctgtttagattacaaatggctaaaagtagctaaaaaatagctgctaaagtttatctcgcgagattgaaacagggccttaaaatgagtcaactaatagaccaactaattattagctattagtcgttagcttctttaatctaagctaaaaccaactaatagcttatttgttgaattacaattagctcaacggaattctctgtttttctaaaaaaaaactgcccctctcttacagcaaattgtccgctgcccgtcgtccagatacaatgaacgtacctagtaggaactcttttacacgctcggtcgctcgccgcggatcggagtccccggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaaggatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgagctagacccagctttcttgtacaaagtggccgttaacggatccagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcaagctgttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccatttcaaatatttttttcaaaataaaagaatgtagtatatagcaattgcttttctgtagtttataacttcgtatagcatacattatacgaagttatacttttctaatatatgaccaaaatttgttgatgtgcaggtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgatgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacataaagctttccactggttgccatatatgatttgggcatttcactttgatcttaatgggccttgtaaagcccaagactcatgattatctttagttgatgctcttaattaggtgtgggcaaataattcaaactgtatgtacccgaccaaaaccaaagcaaaaataatcgaaccaaaccgaaaatttaaaaataaccgaatgaaaactaaatcctataactgaaagaactgaaaccgaatcaaaatatttaatgtaaccaaaaatatccgaaatataattatattgtcaaaaatattaataatttctagattaaataattaaaaatacttaaaaatttatataaaatagtaaaaatactcgaaaataaccacaaatattcaaaaacaaccgaaatatcccaaaatattcaaagcaaaataaccgaatggataccaaattttaaaaccgaaaaaactggaacaaaaccaaaatcgaaccaaaatttcaaaaatcgaataaatactaaactttagaacaaaaaaaaacgataaccgaatgtatacgaaccaaagccgaattagataaccgaacgtccaggactactcttaatctttccgccacttatgatttgggctattactttgtttataatgagccttttcaagctcaagttcatgattgtccgtgagatgagaaactgacttgttggattcgaaaccctagctagtattggttaatacttaatacataaatgacctgcattgacatcatcatccaagaaaataaaaattgtatgcttgagatatttagttttcctagctaggttttctttattttagtaccgaatctttaggtgtgccacgttaatttagacccattttttcatacttaccaactgagtctagtttaatcatgactataatcgtataaaatgattcagtcgacgtcattgcgaacgtatataaaatcatccaaattgacgtcattccaaagaggtaagcatgcttatctaagagtccgagcatactaaacaagacgacattttatttgcactccaaatcaaattttgtattgcctaaagaaaaacaatcaaactcaagtttcttaaaattaatttcattcaaactaatcactttcaatatctcacatattattcatgccatttctatttgtctaaacatgatttaaaaaaaaaagtaaaatacaaagattactatgcaaaaactctataaaaaaaaattcaaatttcttatttatttgtgacatcaaattttcaaaataatttttttaattatcggttgatccggtcagtcgataaaaacataaactttcagcgaccgttaaaactttcctactaccgatttagagaaaatcttagcttgaaacgtaattgtaacctgccttcatgcaagtcgcaagatatgtcatcctaagttgtatatgttttctcaaaagatgtatttacttgagaaaatacgtttcaacgttgatggacaaccaattaagaatcaagcacctttcgtaatcaatttaggcttatcgtctaaggtatactgatttacgacagttgactagacttataaggaacaaaataatagaatagtttctaaacacttcacctaatcatagagactaagatggtaattcgtaaacgacaaagcctagtgacactgtccattgtaaaattccacatcatattagtattaaacatatacatgtagtttcctgaacacatgtagtatcaaacacacttcgtggcttcttcctcgaaacctgcggccgctcattaattaagtcatctagttgaaggatcgctatcaactttgtatagaaaagttgggccgaattcgagctcggtacggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatggcggagccgaagctggaggacttcctcggcggtggaggcggcagcggtggcggaggctccggaggcggtggcatcgggctgtccatgattaagaactggctgcggagccaaccggcgcccggtggaggcggcagcggtggcggaggctccggaggcggtggcgacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggataaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgggttaccgaattcgagctcggtaccctgggatccgatatcgatgggccctggccgaagcttggtcacccggtccgggcctagaaggccgatctcccgggcacccagctttcttgtacaaagtggccgttaacggatcggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatgcttaaaccctcgccgggaggaggactccacgcgcgagcccgcccgcgccacctaccgccgcgcccggatccccgccatggccgccgcgccgcaccgggcccaggtccccgctgcacggctccgttgcagacggggcctgtacttgagaataacccctccaagagtgcaaacgccaaggaccagattctttctggtacagagaatgtgactacaggcaatgcacgtggcgctagctccttgagatcgccaaacggcccaccagagaaggctagctctgtcggaaaagctggagagcaaccttatctctaccagcaaaatgtgtatgcaccacagccacaaccactctatcctggaggatacatgaacccttcaggacaatgggaggaatatccccattatgtgaatatggaggggctccattccgtatctcccgtaagttgctggaattaccgagcttctttgtgttttcttgatttttttctaaatatttttttcttgaagggaatctacaatgacaaccagtccctcatgctatctgctggatatgcaaacaacccccaaatgatgtatggagcatattctcctgtttccactgctggagatggccaacaatacttccctgtgcactattccttctcaaatccttactatcaaccaccagcttctcctagcatgggatattcaaactccgcaactggaatgtcccaaggagaccctatgctgcagcaagagtatttccttcctgatggccttctatattcacccacaccagggtatcatcaaccattcagctcatttgacagagcactgacacagccaaataatgctcctgggttgtttggtcaagggagtctaccactggcttctggaatgcatcatggatcgatgtatggtcctggatcctacaagggacgccagtatggtagcaaatttggtggcactactccaagttggagttctgctggccgcagatttggtactttcgacttgagtggcaatcaacaaagggggagcatgtcatttggtagtcataatggctctctggagtttatgaatgagcaaaaccgtgggccacgtgctacaaaaccaaagatacaagacacagagaactcaggagatgagaaaagcgagaaaactgttcctctaattgatagtgaactgtacaatcgctctgattttatcactgagtacaaggatgccaaattctttgtaataaagtcctacaccgaggaccatgtacataggagcattaaatataatgtttgggctagcacagccagcggaaacaggaagctggattctgcttaccgtgcggccagagagaaagaagagcattgccctattttcttgtttttctcggttaatggaagtggccaattctgtggcgtggctgagatgattggacctgtcgattttgacagaagtgttaattactggcagcaggataagtggagtggccagttcccagtgaagtggcacataattaaggatgtaccgaacaaccttctgcggcacatcattcttgagaacaatgacaataagcctgtcacaaatagcagggacacccaggaggtgaagctggaacagggcctccagatgctaacgatcttcaagagccatgaggctgagacaacaattgtggaagatttcgacttctatgagcagcgggagaaagccttgcaggagaacagacgtcaacagcatgctgccagcaccgatacccagaaactggtggataccaaggctcaagatgctgtggccgacatatcagatgcatttgccaaggccgtccagttgaagaatactgagaacagtgggacaacccccaaaactgagggtgcttcagctgaaaagggttccgctgccacagccaaggttgaaggaagtgcaaacctgaacacaggccctgtggaggaaagcagttgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcggccgccccgggcaactttattatacaaagttgatagatcctcatgtcttcatcgtaagcttaaacaggccagaatggcctctggattcagcggcctagaaggccgaagtacttggtcttcctagtcgagtagatcacattcaagcttggtcacccggtccgtcaatattctgattccgatgacttcgtaggttcctagctcaagccgctcgtgtccaagcgtcacttacgattagctaatgattacggcatctaggaccgactagtggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 504 - DNA, 30349 bp, Artificial Sequence
  RV044485
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatctgcggttaccgaattcgagctcggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtaagtttctgcttctacctttgatatatatataataattatcattaattagtagtaatataatatttcaaatatttttttcaaaataaaagaatgtagtatatagcaattgcttttctgtagtttataacttcgtatagcatacattatacgaagttatacttttctaatatatgaccaaaatttgttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccgggatctgagtcgaaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagatcgatgggccctggccgaagcttggtcacccggtccgggcctagaaggccagcttcaagtttgtaccctggagcttgccgagtgccatccttggacactcgataaagtatattttattttttttattttgccaaccaaactttttgtggtatgttcctacactatgtagatctacatgtaccattttggcacaattacatatttacaaaaatgttttctataaatattagatttagttcgtttatttgaatttcttcggaaaattcacatttaaactgcaagtcactcgaaacatggaaaaccgtgcatgcaaaataaatgatatgcatgttatctagcacaagttacgaccgatttcagaagcagaccagaatcttcaagcaccatgctcactaaacatgaccgtgaacttgttatctagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtactcgacaaagaagccgttgtcgatgtactgttcgtcgagatctctttgtcgagtgtcacactaggcaaagtctttacggagtgtttttcaggctttgacactcggcaaagcgctcgattccagtagtgacagtaatttgcatcaaaaatagctgagagatttaggccccgtttcaatctcacgggataaagtttagcttcctgctaaactttagctatatgaattgaagtgctaaagtttagtttcaattaccaccattagctctcctgtttagattacaaatggctaaaagtagctaaaaaatagctgctaaagtttatctcgcgagattgaaacagggccttaaaatgagtcaactaatagaccaactaattattagctattagtcgttagcttctttaatctaagctaaaaccaactaatagcttatttgttgaattacaattagctcaacggaattctctgtttttctaaaaaaaaactgcccctctcttacagcaaattgtccgctgcccgtcgtccagatacaatgaacgtacctagtaggaactcttttacacgctcggtcgctcgccgcggatcggagtccccggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaaggatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgagctagacccagctttcttgtacaaagtggccgttaacggatccagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcaagctgttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccatttcaaatatttttttcaaaataaaagaatgtagtatatagcaattgcttttctgtagtttataacttcgtatagcatacattatacgaagttatacttttctaatatatgaccaaaatttgttgatgtgcaggtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgatgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacataaagctttccactggttgccatatatgatttgggcatttcactttgatcttaatgggccttgtaaagcccaagactcatgattatctttagttgatgctcttaattaggtgtgggcaaataattcaaactgtatgtacccgaccaaaaccaaagcaaaaataatcgaaccaaaccgaaaatttaaaaataaccgaatgaaaactaaatcctataactgaaagaactgaaaccgaatcaaaatatttaatgtaaccaaaaatatccgaaatataattatattgtcaaaaatattaataatttctagattaaataattaaaaatacttaaaaatttatataaaatagtaaaaatactcgaaaataaccacaaatattcaaaaacaaccgaaatatcccaaaatattcaaagcaaaataaccgaatggataccaaattttaaaaccgaaaaaactggaacaaaaccaaaatcgaaccaaaatttcaaaaatcgaataaatactaaactttagaacaaaaaaaaacgataaccgaatgtatacgaaccaaagccgaattagataaccgaacgtccaggactactcttaatctttccgccacttatgatttgggctattactttgtttataatgagccttttcaagctcaagttcatgattgtccgtgagatgagaaactgacttgttggattcgaaaccctagctagtattggttaatacttaatacataaatgacctgcattgacatcatcatccaagaaaataaaaattgtatgcttgagatatttagttttcctagctaggttttctttattttagtaccgaatctttaggtgtgccacgttaatttagacccattttttcatacttaccaactgagtctagtttaatcatgactataatcgtataaaatgattcagtcgacgtcattgcgaacgtatataaaatcatccaaattgacgtcattccaaagaggtaagcatgcttatctaagagtccgagcatactaaacaagacgacattttatttgcactccaaatcaaattttgtattgcctaaagaaaaacaatcaaactcaagtttcttaaaattaatttcattcaaactaatcactttcaatatctcacatattattcatgccatttctatttgtctaaacatgatttaaaaaaaaaagtaaaatacaaagattactatgcaaaaactctataaaaaaaaattcaaatttcttatttatttgtgacatcaaattttcaaaataatttttttaattatcggttgatccggtcagtcgataaaaacataaactttcagcgaccgttaaaactttcctactaccgatttagagaaaatcttagcttgaaacgtaattgtaacctgccttcatgcaagtcgcaagatatgtcatcctaagttgtatatgttttctcaaaagatgtatttacttgagaaaatacgtttcaacgttgatggacaaccaattaagaatcaagcacctttcgtaatcaatttaggcttatcgtctaaggtatactgatttacgacagttgactagacttataaggaacaaaataatagaatagtttctaaacacttcacctaatcatagagactaagatggtaattcgtaaacgacaaagcctagtgacactgtccattgtaaaattccacatcatattagtattaaacatatacatgtagtttcctgaacacatgtagtatcaaacacacttcgtggcttcttcctcgaaacctgcggccgctcattaattaagtcatctagttgaaggatcgctatcaactttgtatagaaaagttgggccgaattcgagctcggtacggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatggcggagccgaagctggaggacttcctcggcggtggaggcggcagcggtggcggaggctccggaggcggtggcatcgggctgtccatgattaagaactggctgcggagccaaccggcgcccggtggaggcggcagcggtggcggaggctccggaggcggtggcgacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggataaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgggttaccgaattcgagctcggtaccctgggatccgatatcgatgggccctggccgaagcttggtcacccggtccgggcctagaaggccgatctcccgggcacccagctttcttgtacaaagtggccgttaacggatcggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatggccatcccggaggacctagaggggacctcgggcgatggcggggtgacgaatcgcgggagtagagggcggcgaaaaggcgcggcgaaggggcgcgggaggggcaggccgcggagcgccgacagatcctttccgccgccggcgatggctggggtggcggtcggggacagggtgctcagggagaggaggcacacgaccaacgttttctgcgagcgcgacacggatgttgacgatgagtccatttattttcaggatgatgttgagacagttaggtccaaggactcaaggagtggcgatgttttacagactgcaaaaaagaggaagaagggaggtgcagggaaggtttctgtcacaaaaaggtcgaaaagagagggtgaagaacaaaagaaggcatcaccctccaaggataaagattgtgctgaaactaatgggaaaaggaagatgttgactggggataatgccctgatgtgccaccagtgccagaggaatgataaagggagggtggtctggtgtaattcatgcagaaataagcgcttctgtgtgccatgcattgaaagatggtatcctaacttgtcagaagacgaatttgctgcaaaatgcccatattgtcgcaagaactgtaattgcaaaggatgccttagaatgagaggggttgaagagcctccaaagaaggaaatttctgaagaaaatcaaatctcttatgcttgcaatgttgtgcgcttgttgcttccctggttgagaaaactgcgacaggagcagatggaggagaagaaattggaggctaaaataaaaggtgttttggtgaatgagatgaagttggaacaagctgaatataatctagatgagcgtgtctactgcaataattgcaaaacttctatagttgattttcacagaagctgcaagtactgcttttatgatctgtgccttgactgctgtgtggagatccgcagaggtgagattcctggaggagaagagataatgagagtaaagcctgaagatagaggccgagcatatctttttggtactactaactcaaaggatgggagtaaaaggttctccatgaggaggcacagctcatccctggagaatgagccttccaatgtagtaggttctagtgagggggcaaataactctctggagctgtggaaagcagaaagtgatggtagcataccttgcccaccaaaggagctaggaggctgtggcggttcgattttggatctcaagtgtttttttccagaaaagatgctttcaaatttagaagaacgagctgacagaattatgaggagcgaagtatttgcaaaagcagtagccaaaagaagtgaccagtgcccttgttatgaccattcaggaaacataagaactcaggacgtgcgagagactgcaaatacgaaaggctcaagtgataaccatctctactgcccagttgccactgctatcaaggaggatgacttggcgcactttcagatgcactggacaaaaggcgaaccagttattgtttctgatgttctgcatttgacttctggtctaagttgggaaccattagttatgtggcgggcattgcgagagaaaaagactaatggtgacgtagaagatgagcactttgctgtcagggcattagattgccttgattggtgtgaggtggaaattaacatacacatgttttttgtgggatatatgaaaggcagaacgcatcacatgacacactggcctgagatgcttaagctaaaggactggccgccatctagttcttttgatcagagattgcctcgccatggtgctgagtttatcagtgcattgccatttcctgagtacactgatcctcgatatggtccgctgaatcttacagtcaagctacctgatggtgcattgaagccagatcttggaccaaaaacttacatcgcttatggattttaccaagagttaggcaggggtgattctgtgaccaagcttcactgtgacatgtctgatgcggtaaatatattgacacacacagcacaagtgccctatgcgcgttatcaacttgagaagatagaggaaaccagaaagaaaatgaaagaacaagatcttcaggaactttatggtgtttcagaactaaacctatcatcaccttttactgattccaggaatataagtgctgatgaaatgtcaaagacctcatgtttggacgtcaatgatgtaccacctgttaataatgaatctgaggtacaaagtggggcaggccagtgttcagattacattgacaaggatagaagttatgctgggatgcataacggggagagaaccggtggtgccttatgggatattttccgaagagaagattctgacaagatacaagattatcttaggaaacatgccacggaattccggcacatcttttgcaatcctgtgaagcaggttattcacccaattcacgatcagactttctacttaaccgaggagcataagagaaagctcaaggaagaatatggtgttgaaccctggacgtttgagcagaagcttggtgaagcggttttcattcctgctggatgtcctcaccaagtgaggaacttgaagtcttgcattaaggttgcgatggactttgtctccccagaaagcgtcaacgagtgcatgaaactgactggagagtttaggcggcttccacctgatcacagggctaaagaggataagctggagatcaagaagattgctcttcatgctctgaaccaagtagtaaatttcttggatccttcctcggagtggtcgaagagttggtttgcccaactcaagaacaaaaaaaaggctggagctgaagaacaggagaagcctaaaaggaagcgtggccgcccatgtcgcaagtccaacgatgaagctgctggcgataggcacagaaagaagggcggccgccaaagaggtcggaagaggggatacggcaagtccaaagatggcgctggcgctgttgatgtgaagcctcctaaaaggcagcgcaatctcctgaaaggctctggcaatcgtgtaggtggttgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcggccgccccgggcaactttattatacaaagttgatagatcctcatgtcttcatcgtaagcttaaacaggccagaatggcctctggattcagcggcctagaaggccgaagtacttggtcttcctagtcgagtagatcacattcaagcttggtcacccggtccgtcaatattctgattccgatgacttcgtaggttcctagctcaagccgctcgtgtccaagcgtcacttacgattagctaatgattacggcatctaggaccgactagtggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 505 - DNA, 29716 bp, Artificial Sequence
  RV044675
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatctgcggttaccgaattcgagctcggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtaagtttctgcttctacctttgatatatatataataattatcattaattagtagtaatataatatttcaaatatttttttcaaaataaaagaatgtagtatatagcaattgcttttctgtagtttataacttcgtatagcatacattatacgaagttatacttttctaatatatgaccaaaatttgttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccgggatctgagtcgaaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagatcgatgggccctggccgaagcttggtcacccggtccgggcctagaaggccagcttcaagtttgtaccctggagcttgccgagtgccatccttggacactcgataaagtatattttattttttttattttgccaaccaaactttttgtggtatgttcctacactatgtagatctacatgtaccattttggcacaattacatatttacaaaaatgttttctataaatattagatttagttcgtttatttgaatttcttcggaaaattcacatttaaactgcaagtcactcgaaacatggaaaaccgtgcatgcaaaataaatgatatgcatgttatctagcacaagttacgaccgatttcagaagcagaccagaatcttcaagcaccatgctcactaaacatgaccgtgaacttgttatctagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtactcgacaaagaagccgttgtcgatgtactgttcgtcgagatctctttgtcgagtgtcacactaggcaaagtctttacggagtgtttttcaggctttgacactcggcaaagcgctcgattccagtagtgacagtaatttgcatcaaaaatagctgagagatttaggccccgtttcaatctcacgggataaagtttagcttcctgctaaactttagctatatgaattgaagtgctaaagtttagtttcaattaccaccattagctctcctgtttagattacaaatggctaaaagtagctaaaaaatagctgctaaagtttatctcgcgagattgaaacagggccttaaaatgagtcaactaatagaccaactaattattagctattagtcgttagcttctttaatctaagctaaaaccaactaatagcttatttgttgaattacaattagctcaacggaattctctgtttttctaaaaaaaaactgcccctctcttacagcaaattgtccgctgcccgtcgtccagatacaatgaacgtacctagtaggaactcttttacacgctcggtcgctcgccgcggatcggagtccccggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaaggatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgagctagacccagctttcttgtacaaagtggccgttaacggatccagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcaagctgttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccatttcaaatatttttttcaaaataaaagaatgtagtatatagcaattgcttttctgtagtttataacttcgtatagcatacattatacgaagttatacttttctaatatatgaccaaaatttgttgatgtgcaggtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgatgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacataaagctttccactggttgccatatatgatttgggcatttcactttgatcttaatgggccttgtaaagcccaagactcatgattatctttagttgatgctcttaattaggtgtgggcaaataattcaaactgtatgtacccgaccaaaaccaaagcaaaaataatcgaaccaaaccgaaaatttaaaaataaccgaatgaaaactaaatcctataactgaaagaactgaaaccgaatcaaaatatttaatgtaaccaaaaatatccgaaatataattatattgtcaaaaatattaataatttctagattaaataattaaaaatacttaaaaatttatataaaatagtaaaaatactcgaaaataaccacaaatattcaaaaacaaccgaaatatcccaaaatattcaaagcaaaataaccgaatggataccaaattttaaaaccgaaaaaactggaacaaaaccaaaatcgaaccaaaatttcaaaaatcgaataaatactaaactttagaacaaaaaaaaacgataaccgaatgtatacgaaccaaagccgaattagataaccgaacgtccaggactactcttaatctttccgccacttatgatttgggctattactttgtttataatgagccttttcaagctcaagttcatgattgtccgtgagatgagaaactgacttgttggattcgaaaccctagctagtattggttaatacttaatacataaatgacctgcattgacatcatcatccaagaaaataaaaattgtatgcttgagatatttagttttcctagctaggttttctttattttagtaccgaatctttaggtgtgccacgttaatttagacccattttttcatacttaccaactgagtctagtttaatcatgactataatcgtataaaatgattcagtcgacgtcattgcgaacgtatataaaatcatccaaattgacgtcattccaaagaggtaagcatgcttatctaagagtccgagcatactaaacaagacgacattttatttgcactccaaatcaaattttgtattgcctaaagaaaaacaatcaaactcaagtttcttaaaattaatttcattcaaactaatcactttcaatatctcacatattattcatgccatttctatttgtctaaacatgatttaaaaaaaaaagtaaaatacaaagattactatgcaaaaactctataaaaaaaaattcaaatttcttatttatttgtgacatcaaattttcaaaataatttttttaattatcggttgatccggtcagtcgataaaaacataaactttcagcgaccgttaaaactttcctactaccgatttagagaaaatcttagcttgaaacgtaattgtaacctgccttcatgcaagtcgcaagatatgtcatcctaagttgtatatgttttctcaaaagatgtatttacttgagaaaatacgtttcaacgttgatggacaaccaattaagaatcaagcacctttcgtaatcaatttaggcttatcgtctaaggtatactgatttacgacagttgactagacttataaggaacaaaataatagaatagtttctaaacacttcacctaatcatagagactaagatggtaattcgtaaacgacaaagcctagtgacactgtccattgtaaaattccacatcatattagtattaaacatatacatgtagtttcctgaacacatgtagtatcaaacacacttcgtggcttcttcctcgaaacctgcggccgctcattaattaagtcatctagttgaaggatcgctatcaactttgtatagaaaagttgggccgaattcgagctcggtacggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatggcggagccgaagctggaggacttcctcggcggtggaggcggcagcggtggcggaggctccggaggcggtggcatcgggctgtccatgattaagaactggctgcggagccaaccggcgcccggtggaggcggcagcggtggcggaggctccggaggcggtggcgacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggataaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgggttaccgaattcgagctcggtaccctgggatccgatatcgatgggccctggccgaagcttggtcacccggtccgggcctagaaggccgatctcccgggcacccagctttcttgtacaaagtggccgttaacggatcggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatggggtgcaaggggtccaagcttgacgaccaggaggccgtcgcgctctgccgcgcccgcgccgagctgctcgccgcggccgtccgccaccgctacgcgctcgccgacgcgcacgcggccctcgcggactccatcgactcggtcgccgcgccgctgcaccgcctcctccgtctgcaggctcagccgcgggggctcgtactgccctccgcgcgcaagggcggtggcgcgcccgcgaaccggttgctgccgcgctccttcgacccgtcctcggcgctgcctgcccacggccattcctcgcaaccccagttcggcgcgtcgccgggatccgagccggcgccgacggccgactcgcctccgcgccgccgccgccgcgtacccgagcagctgccgcacccgcattacgccgcgtacgggtacgactacgcgacgcagcccgcgtacgcgtatccggcgccggcgagctcgctgcagttctactacgctcgcagccgcccgccccccgcgtcagtcgccgtcacgcagcgcgcgccggggacgtcggagcgcgtgcactttggctcgttcgacgcggcgggcggctacccgcagcactacgcctacagcgcccagcgggcccaggccccgcctccggttgcgccgcagcggtctgctccgccttcgcctccgaaggcgagctcgtgggacttcctgaacgtgttcgagaactacgactcgtacgaacacgacagctactactacgactccgccacggcacctgctgcgcccgcggcgccgttcatgccgagccggagttcgcgggaggtgcgcgaggaggagggtattccggacctagaagacgacggcgaggaagacagcgtgggcgtggtcgtgaaagaggtggccgggcagtactcagcacctgggaatggcggtgcccgtagccggcgcaactcgctcggcggtgccagtagcaccgccgagctcgaccagccggagaatgctatcgcccataaggacgtcatcggcgagtttcggcgaaggccaacagcacatggtaatgtgtcggtgcacgcgccaccacctcccgcgcggagggtcgtcgacaatgcgagtgtagctggcgaaatcaaggcacagcttgtccgcacggccgaggcggctaggcagctcgcgccgatgctcgaagtcggaaggccaagctaccaaggccgcagctcagtctaccaatgttcctcaaagatgatgtcggctatctccgtggctcatttggggtgcaaagacatggacgtgttggacgtcggagtggtagggaagatggtggacacgcggagcctatcctcggcacttgacaagctctatttctgggagaggaagctgtatgctgaggtcaaggctgaggagaaaacgcgcctacttattgccaagaactccaagcgactgaaattattagatcaaaagggtacagagcctgaaaagatagatgaaactcgaaatttgttgaggaagctttcaacaaagataaggatagctgtgcgcgttattgccaagatttcaagaaaaataaacaaattaagggatgaggaattgtggccacaagttaacgctttgattcaagggtttgtactaatgtggcaagataaattggacgcgtaccatagtcagtgtcaagtgatatcagaagccaaaaactttacttcggttttgtcaggtggaaatggccaggatttggtgttagagcttgaggtagagctgattaaatggatcatcagtttttcttcttgggtgaattcacaaaggaactttgtaaaggcactgaatggatggctagcactctgtcttaactatgagcctgaggataatactactggagctccatcttactcaccaggaagcattggtgctccactggttttcgttacctgcaacaaatggtctcaagccatggatcggatttctgagaaggatgtggttaatgccatgcaagctctagtgtctagcgtgtggcacctatgggagcagcagtatcttgagcaaagtgaacaaataatctcgatgcgagaaagggaaaaatggatcaagattttagagagaagaacccaggatattaataaggaggctgatgagctaaacaagaagttggcgttaataccaagccggcaaaggatgcatgtgcctcggagagtacaactgtatgaggcgcactgtgttgaggcaagtaacttgcacataaatctgaggctggttcttgaagctttagagaactttgctgccaattcactgcaagctttccaggatgtggcaaaaagtgctgaagggacaagactgccaagagataatgtgagaagagagcaccgtagttcggaaagaagttcaaactacaaaactagctagggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcggccgccccgggcaactttattatacaaagttgatagatcctcatgtcttcatcgtaagcttaaacaggccagaatggcctctggattcagcggcctagaaggccgaagtacttggtcttcctagtcgagtagatcacattcaagcttggtcacccggtccgtcaatattctgattccgatgacttcgtaggttcctagctcaagccgctcgtgtccaagcgtcacttacgattagctaatgattacggcatctaggaccgactagtggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 506 - DNA, 15 bp, Zea mays
cgcctgttcggcgtc

SEQ ID NO: 507 - DNA, 15 bp, Zea mays
aagctgttcggcgtc

SEQ ID NO: 508 - DNA, 27 bp, Zea mays
cactaccgcggcgtccgcaagcgcccg

SEQ ID NO: 509 - DNA, 27 bp, Zea mays
cgcttccgcggcgtccgcaagcgcccg

SEQ ID NO: 510 - DNA, 18 bp, Zea mays
accctgctgctgttccgc

SEQ ID NO: 511 - DNA, 18 bp, Zea mays
accctgctgctgcagccg

SEQ ID NO: 512 - DNA, 18 bp, Zea mays
ttcgacctgaacctgccg

SEQ ID NO: 513 - DNA, 15 bp, Zea mays
cgcatcggccgcctg

SEQ ID NO: 514 - DNA, 180 bp, Zea mays
cgcccgcgctatcgcggcgtgcgccagcgcccgtggggcaaatgggcggcggaaattcgcgatccggtgaaagcggcgcgcgtgtggctgggcacctttgcgaccgcggaagatgcggcgcgcgcgtatgatgatgcggcgctgcgctttcgcggcgcgaaagcgaaactgaactttccg

SEQ ID NO: 515 - DNA, 174 bp, Zea mays
cgctttcgcggcgtgcgcaaacgcccgtggggccgctatgcggcggaaattcgcgatccggcgaaaaaagcgcgcgtgtggctgggcacctttgatagcgcggaagatgcggcgcgcgcgtatgatgcggcggcgcgcatgctgcgcggcccgaaagcgcgcaccaactttccg

SEQ ID NO: 516 - DNA, 174 bp, Zea mays; identical to SEQ ID NO: 515

SEQ ID NO: 517 - DNA, 174 bp, Zea mays
cgctttcgcggcgtgcgcaaacgcccgtggggccgctttgcggcggaaattcgcgatccggcgcgcaaagcgcgcgtgtggctgggcacctttgataccgcggaagcggcggcgcgcgcgtatgatgcggcggcgctgcattttcgcggcccgaaagcgaaaaccaactttccg

SEQ ID NO: 518 - DNA, 291 bp, Triticum aestivum
ccgtttacccaggcgccgccgcagcagccgctgcatccgcagctgcagcagtatacccaggcgccgccgcagcagccgctgcagccgccgctgcagctgtatccgcaggcgcagccggaacagccgctgcagccgcagagcagcggcagcaccaccggcacctgcgtgattagcgcggcggcgccgagcgcgaccggcaccctgctgctgcagccgccgccgcagcagagcccgcagagccagctgcagctgcatcagcagccgcagccgaccctggtgccgccgccgcag

SEQ ID NO: 519 - DNA, 261 bp, Zea mays
aaaaaactgacccgctttccgattagccgcctgaaacgcattatgcagctgaacgaagatattggcaaaattggcgcgagcgtgccggtggtggcgagcaaagcgattgaaatgtttctgaccgaaattgtgggcctgaccctgaaagaagcgcgcaaaaaaagcagcagccgcatgagcagcgaatttattattcgcgcgaccgaaagcgatccgaaatttgcgtttctgaaaaacatggaacagtttaaaaaccgcgaa

SEQ ID NO: 520 - DNA, 291 bp, Zea mays
ccggtgggcaacatgggcaccaacagcaacaacaacaacgaactgggcgatgtgtttgatcgcattaaaacccattttccgccggcgaaagtgaaaaaaattatgcagaccgatgaagatattggcaaagtgagccaggcgaccccggtgattgcgggccgcagcctggaattttttattgcgctgctggtgaaaaaaagcggcgaaatggcgcgcggccagggcaccaaacgcattaccgcggaaattctgaaaaaaaccattctgaacgatgaaaaatttgattttctg

SEQ ID NO: 521 - DNA, 276 bp, Zea mays
ccgaccaacaacaacgatagcgaaaccaaaccgaacccggcgacctattggaaaagccgctttccggtggcgcgcattaaaaaaattatgcaggcggatcaggatgtgggcaaagtggcgcaggtgaccccggtgattatgagcaaagcgctggaactgtttatgcagagcattattcaggaaagctgcaaacagacccgcctgcatcaggcgaaacgcgtgaccgtgagccatctgaaacatgcggtgcagagcgtggaacagtttgattttctg

SEQ ID NO: 522 - DNA, 27 bp, Zea mays
accctgccgctgtttccgacctgcggc

SEQ ID NO: 523 - protein, 5 aa, Zea mays
RLFGV

SEQ ID NO: 524 - protein, 5 aa, Zea mays
KLFGV

SEQ ID NO: 525 - protein, 9 aa, Zea mays
HYRGVRKRP

SEQ ID NO: 526 - protein, 9 aa, Zea mays
RFRGVRKRP

SEQ ID NO: 527 - protein, 6 aa, Zea mays
TLLLFR

SEQ ID NO: 528 - protein, 6 aa, Zea mays
TLLLQP

SEQ ID NO: 529 - protein, 6 aa, Zea mays
FDLNLP

SEQ ID NO: 530 - protein, 5 aa, Zea mays
RIGRL

SEQ ID NO: 531 - protein, 60 aa, Zea mays
RPRYRGVRQRPWGKWAAEIRDPVKAARVWLGTFATAEDAARAYDDAALRFRGAKAKLNFP

SEQ ID NO: 532 - protein, 58 aa, Zea mays
RFRGVRKRPWGRYAAEIRDPAKKARVWLGTFDSAEDAARAYDAAARMLRGPKARTNFP

SEQ ID NO: 533 - protein, 58 aa, Zea mays; identical to SEQ ID NO: 532

SEQ ID NO: 534 - protein, 58 aa, Zea mays
RFRGVRKRPWGRFAAEIRDPARKARVWLGTFDTAEAAARAYDAAALHFRGPKAKTNFP

SEQ ID NO: 535 - protein, 97 aa, Triticum aestivum
PFTQAPPQQPLHPQLQQYTQAPPQQPLQPPLQLYPQAQPEQPLQPQSSGSTTGTCVISAAAPSATGTLLLQPPPQQSPQSQLQLHQQPQPTLVPPPQ

SEQ ID NO: 536 - protein, 87 aa, Zea mays
KKLTRFPISRLKRIMQLNEDIGKIGASVPVVASKAIEMFLTEIVGLTLKEARKKSSSRMSSEFIIRATESDPKFAFLKNMEQFKNRE

SEQ ID NO: 537 - protein, 97 aa, Zea mays
PVGNMGTNSNNNNELGDVFDRIKTHFPPAKVKKIMQTDEDIGKVSQATPVIAGRSLEFFIALLVKKSGEMARGQGTKRITAEILKKTILNDEKFDFL

SEQ ID NO: 538 - protein, 92 aa, Zea mays
PTNNNDSETKPNPATYWKSRFPVARIKKIMQADQDVGKVAQVTPVIMSKALELFMQSIIQESCKQTRLHQAKRVTVSHLKHAVQSVEQFDFL

SEQ ID NO: 539 - protein, 9 aa, Zea mays
TLPLFPTCG

SEQ ID NO: 540 - DNA, 375 bp, Zea mays
caaagagttctcctgggcaggtccgatgtctctgggtggggcgccttcctgaaaaattccgtctctaagcatgagtatcttggagaatatacaggggagcttatttcccacaaggaagccgacaaaaggggtaagatatatgaccgcgagaatagcagcttcctcttcaatctgaataatgagtacgtcctggatgcctacagaatgggcgataagttgaaattcgcaaaccatgctccagatccaaactgttatgctaaggttatcatggtcaccggcgaccatagagtcggcatatttgctaaagaacgcattctcgcgggtgaggagctgttttacgattataggtatgaaccggacagggcgcccgcgtgg

SEQ ID NO: 541 - DNA, 375 bp, Zea mays
cagaggattctcctcggtcggtctgatgtcgcgggctggggtgcattcataaaaaatcccgtgaacaaaaatgattatctgggcgaatatacgggagaacttatatcacacaaagaagcagacaaaaggggtaaaatatatgaccgggccaactcaagctttcttttcgaccttaacgatcaatatgttctggatgcgtacagaaaaggcgataagttgaaatttgcgaaccactcctccaatcctaactgttatgctaaagttatgttggtcgcaggggaccaccgggttggcatatacgccaaagaacatatcgaagcaagcgaggagttgttttacgactatcggtacggaccagaccaagctcctgcatgg

SEQ ID NO: 542 - DNA, 375 bp, Zea mays
cagcggatattgctgggaaggtccgacgttgcaggctggggggcgttcataaagaacccggtgaacaaaaatgactaccttggagagtacactggcgaactgatttcccacaaagaagcagataagcgggggaaaatttatgacagagcaaactcgtcgtttttgttcgacctgaatgatcagtacgttttggacgcttaccgcaaaggggataagctcaagttcgctaaccactcgtctaatcccaactgttatgcaaaggtgatgctggttgcgggcgaccatcgggttggtatctacgcgaaggagcacatagaggcgagcgaggagttgttttacgactatcggtatggcccggatcaggccccggcatgg

SEQ ID NO: 543 - DNA, 375 bp, Homo sapiens
aagcatctgctgctcgctccctccgatgtcgcgggttgggggatattcattaaggaccctgtgcaaaaaaacgaatttattagcgagtattgcggcgaaatcatctcgcaggacgaggctgacagacggggtaaagtttatgacaaatatatgtgtagcttcctgtttaatctgaacaacgacttcgtggtggatgccactcgcaagggaaacaagatccgctttgctaaccacagcgtgaacccaaattgctacgccaaagttatgatggtgaacggcgatcatagaattggcatatttgcgaagagagctattcaaactggagaggagctcttctttgactacagatattcccaggcggacgctctcaaatat

SEQ ID NO: 544 - DNA, 375 bp, Mus musculus
aagcatctcctgttggcaccgagcgacgtggccggttggggaattttcataaaagatcctgtgcaaaagaatgagtttatatcggaatactgtggtgagattatctcccaggatgaagccgaccggcgcggaaaagtgtatgataaatatatgtgttcgtttctctttaaccttaataacgacttcgtcgttgatgcgacgcggaaaggtaataaaatcagatttgcgaaccactcggtgaacccgaactgctatgcaaaagtcatgatggtcaatggcgatcatcggatcggtatttttgctaagagagccatacaaacaggcgaagaactcttctttgattataggtactctcaggctgatgcactcaagtat

SEQ ID NO: 545 - protein, 125 aa, Zea mays
QRVLLGRSDVSGWGAFLKNSVSKHEYLGEYTGELISHKEADKRGKIYDRENSSFLFNLNNEYVLDAYRMGDKLKFANHAPDPNCYAKVIMVTGDHRVGIFAKERILAGEELFYDYRYEPDRAPAW

SEQ ID NO: 546 - protein, 125 aa, Zea mays
QRILLGRSDVAGWGAFIKNPVNKNDYLGEYTGELISHKEADKRGKIYDRANSSFLFDLNDQYVLDAYRKGDKLKFANHSSNPNCYAKVMLVAGDHRVGIYAKEHIEASEELFYDYRYGPDQAPAW

SEQ ID NO: 547 - protein, 125 aa, Zea mays; identical to SEQ ID NO: 546

SEQ ID NO: 548 - protein, 125 aa, Homo sapiens
KHLLLAPSDVAGWGIFIKDPVQKNEFISEYCGEIISQDEADRRGKVYDKYMCSFLFNLNNDFVVDATRKGNKIRFANHSVNPNCYAKVMMVNGDHRIGIFAKRAIQTGEELFFDYRYSQADALKY

SEQ ID NO: 549 - protein, 125 aa, Mus musculus; identical to SEQ ID NO: 548

SEQ ID NO: 550 - DNA, 3999 bp, Artificial Sequence
  dCasAlpha10-Dr1 repressor
acgtctaatcccatctagacctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacccgtcctccctataagtagctatcccagcaccgtcgtctatcaaccacacacagagcggcatttcgaataacacaggtgagcgcgacggtcgactctagaggatccatggcaccgaagaagaagcgcaaggtgatgggcgagagcgtcaaggcaataaaattaaagatcctcgacatgttcctcgaccccgagtgcaccaagcaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggacgacaactggcgcaaggacctcagcaccatgagccgcttctgcggcgaggccggcaacatgtgcctcagggacctctacaactacttcagcatgcccaaggaggaccgcatcagctccaaggacttatataacgccatgtaccataaaactaagctcctccaccccggcctccccgggaaggtggctaaccaaatcgtcaaccacgccaaggacgtctggaagcgcaacgccaagctcatctaccgcaaccaaatcagcatgcccacatataagatcaccaccgcccccatccgcctccaaaataacatctacaaattaataaaaaataagaacaaatacataatcgacgtccagctctacagcaaggagtacagcaaggacagcggcaagggcacccacaggtacttcctcgtcgccgtcagggacagcagcaccaggatgatcttcgacaggatcatgagcaaggaccacatcgacagcagcaagagctacacccagggccagctccaaatcaagaaggaccaccagggcaagtggtactgcatcatcccctatacattccccacccacgaaaccgtcctcgaccccgacaaggtcatgggcgtcgccctcggggtggctaaggccgtctactgggctttcaacagcagctataaaagaggctgcatcgacggcggcgagatcgagcacttcaggaagatgatcagggcccggcgcgtcagcatccagaatcaaatcaaacacagcggcgacgcccgcaagggccacggcaggaagagggccctcaagcccatcgaaaccctcagcgagaaggagaagaacttccgcgacacaataaaccacaggtacgccaacaggatcgtcgaggccgctatcaagcagggctgcggcaccatccagatcgagaacctcgagggcatcgctgacaggaccggcagcaagttcctcaagaactggccctactacgacctccagaccaagatcgtcaataaagccaaggagcacggcatcaccgtcgtcgcaataaacccccagtatacatcccagcgctgcagcatgtgcggctacatcgagaaaaccaacaggagcagccaggccgtgttcgagtgcaagcagtgcggctacggcagccgcaccatctgcatcaactgcaggcacgtccaagtctccggcgacgtctgcgaggagtgcggcggcatcgtcaagaaggagaacgtcaacgccgactacaacgccgccaagaacatcagcaccccctacatcgaccagataataatggagaagtgcctcgagctcggcatcccctaccgctccatcacctgcaaggagtgcggccacatccaggctagcggcaacacctgcgaggtctgcggcagcaccaacatcctcaaaccaaagaagatccgcaaggcaaaaaagagaccacgggaccgccacgatggcgagctgggaggccgcaagcgggcaaggggaggatccagctcccaacagcaacaacagcagcaacagcagcagcagcagcagcaacagcaacagcaacagcagcagcagcagcagcagcaacagcagcaacaaggcgcgcctaaaaaactgacccgctttccgattagccgcctgaaacgcattatgcagctgaacgaagatattggcaaaattggcgcgagcgtgccggtggtggcgagcaaagcgattgaaatgtttctgaccgaaattgtgggcctgaccctgaaagaagcgcgcaaaaaaagcagcagccgcatgagcagcgaatttattattcgcgcgaccgaaagcgatccgaaatttgcgtttctgaaaaacatggaacagtttaaaaaccgcgaataggcggccgcaactagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcggcgcgccccatgg

SEQ ID NO: 551 - DNA, 1089 bp, Hordeum vulgare
tttagtttgagacgtatcatgtcgcccgaggcgaggggacgcgaggggtacgcgagaatttcctccgtttgctagcagttgcagatctatgcaatgattccgtgtgaagatgggatgacggtagatcctaagcgtgcgcatggagtacgcgttctggaacacctaggccggttggtactatcaccttgatatgtgggcagatgctgattagatggtgctcattagtcatggcacatctttatacttaggtgtagtgatttcgtttgccttgacgatgactttagattgatcgttgtattcattttgtgaggctgtgatgaataactaataaagatgactacatgcattattttgatgcaaaggccgggagcaatctttcctttaaaaaaaaaacttcacatcaagacacttaaaatggcaacctgtcccttactactgctaaacagcaagtgggtgaacatctttatgcagtaatttgcacgggtacgccatcccatataaacagcactgtatgaaagctgcattcagttttctttctacatcagcacaggcagcttcataaggtcttgtctgggcagaagaaagacgagtatccggatattttttgtggtctctgatttatctccctacgtgcaacagtacagttaaacgaaggtgattaaacttacagtaagtcagtaacttgaactggtacctcatcgcataaactgccactgcattcagttttctttctatatcaacacaggcagctccataactcataaccaaccttaacatccaaggttattttcaggtgcaccagggctagtgatagtacataaagtctacttttgttcagaaaatgaataataccatggcaaacttggctacgggacacccaacatgacattttgggccatttaatttgctgcaaaatactgaaatactttactcggctgcattacaattatcaaggtcaatgtcaatattgccctcggaactctaatcctactgctatacaagtgcccacactcagactttctgacgaagaacagagccgccactcaccacagcaatcctcttcccttcgccagcacgagcaaggagcgg

SEQ ID NO: 552 - DNA, 3803 bp, Artificial Sequence
  apomixis trait expression cassette
acgtctaatcccatctagatttagtttgagacgtatcatgtcgcccgaggcgaggggacgcgaggggtacgcgagaatttcctccgtttgctagcagttgcagatctatgcaatgattccgtgtgaagatgggatgacggtagatcctaagcgtgcgcatggagtacgcgttctggaacacctaggccggttggtactatcaccttgatatgtgggcagatgctgattagatggtgctcattagtcatggcacatctttatacttaggtgtagtgatttcgtttgccttgacgatgactttagattgatcgttgtattcattttgtgaggctgtgatgaataactaataaagatgactacatgcattattttgatgcaaaggccgggagcaatctttcctttaaaaaaaaaacttcacatcaagacacttaaaatggcaacctgtcccttactactgctaaacagcaagtgggtgaacatctttatgcagtaatttgcacgggtacgccatcccatataaacagcactgtatgaaagctgcattcagttttctttctacatcagcacaggcagcttcataaggtcttgtctgggcagaagaaagacgagtatccggatattttttgtggtctctgatttatctccctacgtgcaacagtacagttaaacgaaggtgattaaacttacagtaagtcagtaacttgaactggtacctcatcgcataaactgccactgcattcagttttctttctatatcaacacaggcagctccataactcataaccaaccttaacatccaaggttattttcaggtgcaccagggctagtgatagtacataaagtctacttttgttcagaaaatgaataataccatggcaaacttggctacgggacacccaacatgacattttgggccatttaatttgctgcaaaatactgaaatactttactcggctgcattacaattatcaaggtcaatgtcaatattgccctcggaactctaatcctactgctatacaagtgcccacactcagactttctgacgaagaacagagccgccactcaccacagcaatcctcttcccttcgccagcacgagcaaggagcggacccgtcctccctataagtagctatcccagcaccgtcgtctatcaaccacacacagagcggcatttcgaataacacaggtgagcgcgacggtcgactctagaggatccatggcaccgaagaagaagcgcaaggtgatgggcgagagcgtcaaggcaataaaattaaagatcctcgacatgttcctcgaccccgagtgcaccaagcaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggacgacaactggcgcaaggacctcagcaccatgagccgcttctgcggcgaggccggcaacatgtgcctcagggacctctacaactacttcagcatgcccaaggaggaccgcatcagctccaaggacttatataacgccatgtaccataaaactaagctcctccaccccggcctccccgggaaggtggctaaccaaatcgtcaaccacgccaaggacgtctggaagcgcaacgccaagctcatctaccgcaaccaaatcagcatgcccacatataagatcaccaccgcccccatccgcctccaaaataacatctacaaattaataaaaaataagaacaaatacataatcgacgtccagctctacagcaaggagtacagcaaggacagcggcaagggcacccacaggtacttcctcgtcgccgtcagggacagcagcaccaggatgatcttcgacaggatcatgagcaaggaccacatcgacagcagcaagagctacacccagggccagctccaaatcaagaaggaccaccagggcaagtggtactgcatcatcccctatacattccccacccacgaaaccgtcctcgaccccgacaaggtcatgggcgtcgccctcggggtggctaaggccgtctactgggctttcaacagcagctataaaagaggctgcatcgacggcggcgagatcgagcacttcaggaagatgatcagggcccggcgcgtcagcatccagaatcaaatcaaacacagcggcgacgcccgcaagggccacggcaggaagagggccctcaagcccatcgaaaccctcagcgagaaggagaagaacttccgcgacacaataaaccacaggtacgccaacaggatcgtcgaggccgctatcaagcagggctgcggcaccatccagatcgagaacctcgagggcatcgctgacaggaccggcagcaagttcctcaagaactggccctactacgacctccagaccaagatcgtcaataaagccaaggagcacggcatcaccgtcgtcgcaataaacccccagtatacatcccagcgctgcagcatgtgcggctacatcgagaaaaccaacaggagcagccaggccgtgttcgagtgcaagcagtgcggctacggcagccgcaccatctgcatcaactgcaggcacgtccaagtctccggcgacgtctgcgaggagtgcggcggcatcgtcaagaaggagaacgtcaacgccgactacaacgccgccaagaacatcagcaccccctacatcgaccagataataatggagaagtgcctcgagctcggcatcccctaccgctccatcacctgcaaggagtgcggccacatccaggctagcggcaacacctgcgaggtctgcggcagcaccaacatcctcaaaccaaagaagatccgcaaggcaaaaaagagaccacgggaccgccacgatggcgagctgggaggccgcaagcgggcaaggggaggatccagctcccaacagcaacaacagcagcaacagcagcagcagcagcagcaacagcaacagcaacagcagcagcagcagcagcagcaacagcagcaacaaggcgcgcctcaaagagttctcctgggcaggtccgatgtctctgggtggggcgccttcctgaaaaattccgtctctaagcatgagtatcttggagaatatacaggggagcttatttcccacaaggaagccgacaaaaggggtaagatatatgaccgcgagaatagcagcttcctcttcaatctgaataatgagtacgtcctggatgcctacagaatgggcgataagttgaaattcgcaaaccatgctccagatccaaactgttatgctaaggttatcatggtcaccggcgaccatagagtcggcatatttgctaaagaacgcattctcgcgggtgaggagctgttttacgattataggtatgaaccggacagggcgcccgcgtggtaggcggccgcaactagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcggcgcgccccatgg

SEQ ID NO: 553 - DNA, 2034 bp, Artificial Sequence
  dCas-alpha10:Mez1
atgggcgagagcgtcaaggcaataaaattaaagatcctcgacatgttcctcgaccccgagtgcaccaagcaggacgacaactggcgcaaggacctcagcaccatgagccgcttctgcggcgaggccggcaacatgtgcctcagggacctctacaactacttcagcatgcccaaggaggaccgcatcagctccaaggacttatataacgccatgtaccataaaactaagctcctccaccccggcctccccgggaaggtggctaaccaaatcgtcaaccacgccaaggacgtctggaagcgcaacgccaagctcatctaccgcaaccaaatcagcatgcccacatataagatcaccaccgcccccatccgcctccaaaataacatctacaaattaataaaaaataagaacaaatacataatcgacgtccagctctacagcaaggagtacagcaaggacagcggcaagggcacccacaggtacttcctcgtcgccgtcagggacagcagcaccaggatgatcttcgacaggatcatgagcaaggaccacatcgacagcagcaagagctacacccagggccagctccaaatcaagaaggaccaccagggcaagtggtactgcatcatcccctatacattccccacccacgaaaccgtcctcgaccccgacaaggtcatgggcgtcgccctcggggtggctaaggccgtctactgggctttcaacagcagctataaaagaggctgcatcgacggcggcgagatcgagcacttcaggaagatgatcagggcccggcgcgtcagcatccagaatcaaatcaaacacagcggcgacgcccgcaagggccacggcaggaagagggccctcaagcccatcgaaaccctcagcgagaaggagaagaacttccgcgacacaataaaccacaggtacgccaacaggatcgtcgaggccgctatcaagcagggctgcggcaccatccagatcgagaacctcgagggcatcgctgacaggaccggcagcaagttcctcaagaactggccctactacgacctccagaccaagatcgtcaataaagccaaggagcacggcatcaccgtcgtcgcaataaacccccagtatacatcccagcgctgcagcatgtgcggctacatcgagaaaaccaacaggagcagccaggccgtgttcgagtgcaagcagtgcggctacggcagccgcaccatctgcatcaactgcaggcacgtccaagtctccggcgacgtctgcgaggagtgcggcggcatcgtcaagaaggagaacgtcaacgccgactacaacgccgccaagaacatcagcaccccctacatcgaccagataataatggagaagtgcctcgagctcggcatcccctaccgctccatcacctgcaaggagtgcggccacatccaggctagcggcaacacctgcgaggtctgcggcagcaccaacatcctcaaaccaaagaagatccgcaaggcaaaaaagagaccacgggaccgccacgatggcgagctgggaggccgcaagcgggcaaggggaggatccagctcccaacagcaacaacagcagcaacagcagcagcagcagcagcaacagcaacagcaacagcagcagcagcagcagcagcaacagcagcaacaaggcgcgcctcaaagagttctcctgggcaggtccgatgtctctgggtggggcgccttcctgaaaaattccgtctctaagcatgagtatcttggagaatatacaggggagcttatttcccacaaggaagccgacaaaaggggtaagatatatgaccgcgagaatagcagcttcctcttcaatctgaataatgagtacgtcctggatgcctacagaatgggcgataagttgaaattcgcaaaccatgctccagatccaaactgttatgctaaggttatcatggtcaccggcgaccatagagtcggcatatttgctaaagaacgcattctcgcgggtgaggagctgttttacgattataggtatgaaccggacagggcgcccgcgtgg

SEQ ID NO: 554 - protein, 678 aa, Artificial Sequence
  dCas-alpha10:Mez1 PRT
MGESVKAIKLKILDMFLDPECTKQDDNWRKDLSTMSRFCGEAGNMCLRDLYNYFSMPKEDRISSKDLYNAMYHKTKLLHPGLPGKVANQIVNHAKDVWKRNAKLIYRNQISMPTYKITTAPIRLQNNIYKLIKNKNKYIIDVQLYSKEYSKDSGKGTHRYFLVAVRDSSTRMIFDRIMSKDHIDSSKSYTQGQLQIKKDHQGKWYCIIPYTFPTHETVLDPDKVMGVALGVAKAVYWAFNSSYKRGCIDGGEIEHFRKMIRARRVSIQNQIKHSGDARKGHGRKRALKPIETLSEKEKNFRDTINHRYANRIVEAAIKQGCGTIQIENLEGIADRTGSKFLKNWPYYDLQTKIVNKAKEHGITVVAINPQYTSQRCSMCGYIEKTNRSSQAVFECKQCGYGSRTICINCRHVQVSGDVCEECGGIVKKENVNADYNAAKNISTPYIDQIIMEKCLELGIPYRSITCKECGHIQASGNTCEVCGSTNILKPKKIRKAKKRPRDRHDGELGGRKRARGGSSSQQQQQQQQQQQQQQQQQQQQQQQQQQQQQQGAPQRVLLGRSDVSGWGAFLKNSVSKHEYLGEYTGELISHKEADKRGKIYDRENSSFLFNLNNEYVLDAYRMGDKLKFANHAPDPNCYAKVIMVTGDHRVGIFAKERILAGEELFYDYRYEPDRAPAW

SEQ ID NO: 555 - DNA, 1500 bp, Zea mays
cccatttttatacatatattcaaattctactccgtaaatagtgcagcacacgacacaaaatagtgttttgggtaatgaaatgctggagacggtccgaatgtcgaccgaagcttttcagacatgctcgctccaaatttaggtcagctgtctctaatctgtgactgcgcgctacgggtacgtaaattttgtagtagcagaacgctaaatctctttcgaatcactgtttttattatgtcgagcaaaaaaaacatagcttcgtcgtgaattttgaattataaatgatcagcgagaatatttcagctgaattaaaatgtcctatacagacaagaaagccttaaatttcggatgctgggaacggtatccgccgctgatcatcctgaggagtaatatagcataataattaaaattattaagcttccaacgccgatgccaacggtcagaaagttcgaaatcattgtgctacatgaacctggtgtaccatcctgcccgtccatcactcttgatctgaatggaatgtccgcatgccgctctcggcccaccatacaccgagcccttcggtcgtcgccagttttgaatttcgaacatgttaaaagccccgcctgcgctgcccaccaccaacggccaaacccccaacaaggacagagcagaaacttagccagagattcgtccaggataggggctgtatcgtagggagtagtcgttgcggagattgggtcgaagcggactggacaggagccgagcaaactgtgagtattgtattttctcttttgcggtttggagggtttggatgtggttgtttggttgcagttttccgagcgttttagtgatgtggtttttcctcttgccatgtcctttcagatctgcagaagaggttaaagggttgccgtgcggactccggagctgtgagaatctaccccgaggtgagaatctctaaacggttgtggccttgagggatgcggttagttcttggtccgattatgttagttcgcccccgaattgctttcttcagacgtgtttcgtggcttctttatgtgtaaatcccttggagggtagagcattgaggcggggttatgagtagaaccgtcgcagattaaatgattatgaccgtgtttctttacgcaatttcttcgtgctattggtacttatacactgctctcctctgcgttgcgtctttcttgcaggtaagctcttagagtcgtagtcaaagaggagaagccaggccgggaacaaacagaaaagtgaggagatttgttggtgcattagctactcacgcgtcccctgaaattctgcttgttaactccatcctaaaatttattgtgtggacccaggagaagagcaacaggagtacaggactcagtgcaccaagaataggaaagagcaaagaccataacagttgtatgagatactgtgatttctgggttcatttgtttatctgattatgcgttctttggtctcttgcatcactcatgtggttgtatccactcctccaggaacttcaag

SEQ ID NO: 556 - DNA, 1086 bp, Arabidopsis thaliana
atggctgagaatcttgcttgtggtgaaaccagcgagtcatggatcattgacaacgacgatgatgatatcaactatggcggcggatttacgaacgagattgattacaatcaccaactttttgctaaagacgacaactttggcggcaacggatcaattccgatgatgggttcttcttcatcgtccttgagtgaagacagaatcaaagagatgttggtgagagagattgagttttgccctggaactgattatgttaagagattgctttctggtgatttggatttgtctgttcgaaaccaagctcttgattggattctaaaggtttgtgctcattaccattttggacatctgtgcatatgcctatccatgaactacttggatcggttcttaacatcctatgaattgccgaaagacaaggattgggctgctcagttactagctgtgtcttgcttatcattagcatccaaaatggaagaaactgatgtgcctcacattgttgatttacaggtggaagatcccaagtttgtttttgaggccaaaacaataaaaaggatggagcttttggttgtcaccactttgaattggagattgcaagctctaactccattctccttcattgattatttcgttgacaagatcagtggtcacgtgtcggagaatttgatctatagatcgtcaagattcatcttaaacaccaccaaagcaattgaattcttagacttcaggccttctgagatagctgcagctgctgcagtgtctgtttccatttcaggagaaacagaatgcattgatgaggaaaaggcactgtctagtctcatatatgtaaaacaggagagggtgaagagatgtttgaatctgatgagaagtctcactggggaggagaatgtgcggggaactagtttatcgcaggagcaggcgcgagttgcggtaagagctgtacctgcaagtccagttggagtgttggaagcaacatgtttgagctataggagtgaagagagaacagttgagtcatgtacaaattcctcacagagtagtccagacaacaacaacaacaacaacaacagcaacaagaggaggagaaaacaatga

SEQ ID NO: 557 - DNA, 927 bp, Arabidopsis thaliana
atggcagaggagaatctagaactgagtcttttatgtacagagagcaacgttgatgatgagggcatgattgttgacgaaactccgattgaaatttcgattcctcagatgggtttttctcaatcggagagtgaggagattatcatggagatggtggagaaggagaagcagcatttgccaagtgatgattacatcaagagacttagaagtggagatttggatttgaatgttggaagaagagatgccctcaattggatttggaaggcttgtgaagtacaccagtttggaccattgtgtttttgcttagcaatgaactacttggatcgattcttatcggttcatgatttgcctagtggcaaaggttggatattgcagttgttggctgtggcttgtttatcattggcagccaaaattgaagaaactgaagttccaatgttgatagatcttcaggttggagatcctcagtttgtgtttgaggctaaatcagtccaaagaatggagcttttggtgttgaacaaattgaaatggagattgagagcaataactccatgctcatacataagatatttcctgagaaagatgagtaaatgtgatcaagaaccatccaacacattgatatctagatcattacaagtgatagccagcacaaccaaaggtattgactttttggagtttagaccttctgaagttgctgctgctgtggcactttctgtttctggagaattgcagagagtacactttgacaactcttccttctctcctcttttctcactacttcaaaaggagagagtgaagaagataggggaaatgatagagagtgatggctcagacttatgttcacaaacacccaatggggttttagaagtatcggcttgttgtttcagctttaagacccatgattcttcttcttcttatacacatctttcttaa

SEQ ID NO: 558 - DNA, 897 bp, Arabidopsis thaliana
atggctgaatttatggaaccaaatcttgtatccaattttgatgatgagaagagcaattctgtcgacacaagatcgatttttcagatgggttttcctctggagagcgaagagatcgttagagagatgattgagaaagagagacaacactcaccgagagatgattacctcaagagactgagaaacggagatttggatttcaatgtcagaatccaagcccttggttggatttggaaggcctgtgaggaacttcaatttggaccattgtgtatatgtctagcaatgaactacttggatcgtttcttatctgttcatgacttacctagtggaaaagcttggactgtacaattgttggctgttgcttgtttatcattggcagctaaaatagaggaaactaatgttccagagttaatgcagctgcaggttggagctcccatgttcgtgtttgaggctaaatcagttcaaaggatggaacttttggtgttgaacgtattgagatggaggttacgggcagtgacaccgtgctcttacgttagatacttcctgagtaagatcaatggctatgatcaagaaccacatagcagattggtaactagatcactacaagtgatagccagcacaaccaaaggtattgacttcttggagtttagagcttcagagattgctgctgcagttgctctttctgtttctggagaacactttgacaaattctccttctcttcttccttctcaagccttgaaaaggagagagtgaagaagattggtgaaatgatagagagagacggatcaagttcaagttcacaaacaccaaataatacagtcttacaatttaagagtcgtcgttattctcattctctttctactgcttctgtttcctcctccctcacttctctttcttaa

SEQ ID NO: 559 - DNA, 987 bp, Glycine max
atggcacccagttttgattgcgtttcgagccttctctgtgccgaagacaacagtatttttgacgaaaacgattatggggatatcgtcgaaaccttagtcaaaagtgatgagtgcttgagactgatggtggagaaggaatgggatcacttgcctaatggtgattatgtgaataggctgaggagtggggatttggattttggggccagaaaagaggccattgattggattgaaaaggttcaacagcactttggttttggacccctctgtgcatatctatccataaactacttggaccgtttcctttctgcatatgaattaccaaagcacagagcttggacaatgcaattgttggctgtggggtgcttatctctggcagccaaaatggaagagactgatgtccctttctctcttgatttgcaggtgggtgaatctaagtatatatttgaggctaaaacaatacagagaatggagcttctggtgctgagcacattgagatggagaatgcaggcaattaccccattttccttcattgaccatttcctttacaagatcaatgatgatcaaagtccaattggagcttcaattttgcaatccatccagcttatactgagcactgtaagaggaattgacttcttagaattcagaccctcagagattgcagcagcagtggcaatatctgtggtgggggagggccaaacagtgcacactgagaaagcaatttctgttctgattcagcttgtggaaaaggagagggtcttgaagtgtgttaaaatgatccaagagctggcatcaaatagtggtggttctgccaagggtgctagtgcttctgtttctgtccctagcgtgcccgaaagcccactaggggtgttggtcactgcatgcttcagctacaaaagtgatgacacaaatgctgcttcatatgcaaattcttcacataacattagtccagatgctaaaaggaggaagctaaacaaaacctttggataa

SEQ ID NO: 560 - DNA, 1074 bp, Glycine max
atggcacccagttttgattgtgtttcgagccttctctgtgtggaagacaacagtatttttgacgaaaacgattatggtggttcggtggaggtgttggaggacgcgtggcaggatcctagatatcgtcgaaaccttagtcaaagtgagaacttggatgtcccaaatgggtggtttcagttgcagagtgatgagtgtttgagactgatggttgaaaaggaatgggatcacttgcctaatggtgattataggaataagctgaggagtggggatttggactttgaggccagaaaagaggccattgattggattcaaaaggttcaagagcactttggttttggacctgtctgtgcatatctatccataaactacttggaccgcttcctttctgcatatgaattaccaaagcatagaacttggacaatgcaattgttggctgttggatgcttatctctggcagccaaaatggaagagactgatgctcctatgtctcttgatttgcaggtgggtgaatctaagtatatatttgaagccaaaacaatacagagaatggagcttctggtgctgagcacattgaggtggagaatgcaggcaattaccccattttccttcattgaccatttcctttacaagatcaatgatgatcaaagtccaattggagcttcaattttgcaatccatccagcttatactgagtactgtaagaggaattgacttcttagagttcagaccctcagagattgcagcagctgtggcaatatctgtggtgggggagggccaaacagtgcaaactgagaaagcaatttctgttctgattcagcttgtggaaaaggagagggtattgaagtgtgttaaattgatccaagagctggcatcaaatagtggtggtggttctgccaagggtgatagtgcttctgtttctgtccctagcgtgccccagagcccaataggggtgttgaacactgaatgcttcagctacaaaagtgatgacacaaatgctgcttcatgtgcaaatacttcacataacaatagtccagatgctaaaaggaggaagctaaacaaaacctttggagaatag

SEQ ID NO: 561 - DNA, 1086 bp, Glycine max
atggctcacaactcagacagtgccacctccaaccttcttctctgttcggagaacagcagcacctgcttcgatgatgatttggaatgttgtgatgccgcagatgggtccaactccagaatctcgcatcagttctgggaccaccatgagggtggtggtggtggtggatcggagttgttggcgtgttttgtggcgcagagtgaggaaactgtgagggctatggtggagagagagagggagcatttgccgagggatgattacttgatgaggctgaggagtggggagttggacttgggtgttaggagggaggctattgattggatttgtaaggctcattcttattttggctttggacccttgagtttttgtttagctgtgaactacttggaccgcttcctatcggtttttgatttaccgagaggtgtgacttggactgtgcaattgttagctgtagcttgcttgtcgattgcggctaaaatggaggagatcaaagtgcctcaatccgtagatttacaggttggggaaccaaagtttgtgtttgaagctagaaccattcaaaaaatggaactacttgtattaagcacattgggatggaaaatgtgcgctataactccttgttccttcatagactacttccttggcaagatcacttgcgagcagcatccagcaaaatcatccgtttcaatatcagtgcagctcatccttggcataatcatgggtattgactacttggaattccggccttctgaaattgctgccgcggtggctgtttctgttttaaaggaattgcaagcgatagaaattgataaggccataattgatctcttagtagtagagaaggtgagagttctgaagtgtgttgaattgataagagatttgtccttgatcaatgttgctgctagtttaggcagcaaggtaccatatgtgccccaaagtccaattggggtgctggatgctgggtgcttaagttataagagtgatgaattaactgttggatcatgtccaaattcttcacataatatttcaaatccaaaccctactaagaggagcaaaccagatggaccttctaatggaacctccaattcatga

SEQ ID NO: 562 - DNA, 933 bp, Glycine max
tgtctgattaaggacaatcatggatcggaacatttttgggatttttctgtactgagcgatgaaactgttatggatttggttgggagggagagcgagcatttgccccacgttggttacctcaagaggctgcttagtggggacttggacttgagtgttaggaatgaggctcttgattggatttggaaggctcatgcttactatggttttggaccctgtagtttatgtctatctgtgaactacttggatcggttcctatcagtatatgaattaccaagaggcaaaagttggagtatacaactgttagcagtagcatgtttgtcaattgctgccaaaatggaggagattaaagtgcctccttttgtagatttacaggttggagaacctaagtttgtatttgaagctaaaaccattcaaagaatggaactactggtgttaagcacattgagatggcaaatgcaggcttcaactccattttccttcctagattacttcctcaggaagatcaactgtgaccaagttatagtaaagtcatccattatgagatcagtaggacccatccttaacataattaaatgtatcaatttcttggaattcaggccctctgaaattgctgcagcagtggcaatttctgtatcaagggaaatacaagcagaagagattgacaaagccttacaaatgcaagcagaagaaactgctgcagcatttactgcattttgttttctaagttatgagggtcttgaattgatcaaagatttgtcattgatgcaagattctgcaaacttgggcaataacttagcatcatttgtaccccaaagccctattggggtgcttgatgctgcatgcttgagctctataagtgatgaattaacagttggatcatatagagattcttcccttgatactccaaattctaagaggaggaaatctgactaa

SEQ ID NO: 563 - DNA, 1870 bp, Oryza sativa
cccgcttcagttggcagctgccctgtttctgcttcatgtcctgcccaaaatgccctcctcctaccctccacgcggctgtgtatacaaagagaacgcatccccccattgctcacttgccccctcctcctctttcacacctcacctcccaccaagataaagagcaagaacagcaagagcaagaagaggaggagggagaccacacaatctatcacaagcttagcaagatttatcagcaaggaaatggcagctctgacgagctacgagatggcggcctccatcttgctctgcgccgaggacagcagcagcgtcctcggcttcggcggcgaggaagaggaagaggaggaggacgtcgtggctgggaagagggccaggtgcgctggtccgccgccgccgccgtgcgtggacgtcgctggcgtggatttcgccgtgccgtcggaggaatgcgtcgcccgcctggtggagacggaggcggaccacatgccgagggaggactacgccgagaggctgcgcgccggcggcggcgacggcgacctggatcttcgcgtcaggatggatgccatcgattggatttggaaggttcactcctactacagcttcgctcctcttactgcctgcttggccgtcaactacttggaccgcttcctctcactctaccagcttccggatggcaaggattggatgacgcagctgctagcagtagcgtgcttgtcgcttgctgccaagatggaggaaaccgatgtgcctcaatcgctggacctgcaggtcggggaagaacggtacgtgttcgaggcgaagacgatccagaggatggagctgctggtcctgagcaccctcaaatggaggatgcaggccgtcactcccttctcctacgtcgactacttcctccgcgagctcaacggcggcgatccgccgtcgggacgctcggcgctgctgtcttcagagctcatcttgtgcatagctagaggaacagaatgcttgggattcaggccgtcggagatcgccgccgcggtcgccgccgccgtggtcggagaagaacacgccgctttctcccatgtaaataaggagaggatgtcgcattgccaggaagtgattcaggccatggagttgatacatccaaaaccttcaagccccagcagagtcttcgtctcctcctccattccacggagccctactggcgtgttggatgcagcaggctgcctcagctacaggagtgacgattcagctgttgcctcacactacgcagcaagcagctggggatatgaacatgatagctccccggttagcagcaagaggaggaagattagcagatgatgcagccaatgatggatcaattaaaagtctgtttatatgtgttgcgaaactgatcgtgcatctctctttcttgggaaagtcaaatggttttgattgcaaatgactgtggagcctttcgatgccgtatgggagctagagcctgaaaggcgatgaaggaccaaaagcaaggcattttcgacatggcaacagagcaaagatactgatggataaagagagtctgaggtagacatgtgctccaatattttcatgtgctttagcgttagttgctaggaggcaggcagccacaaaagagtagaggatttgtgggaagagagccgggcgagatgaaaatgagatgaccaaaataaaggcagagacgaggtgacagtggcacaaggcaaagcgagctaggcactgacactccagatgtcctgcgtgtgtttcagttttgcgttgttctgtaatttcccctgcttaattcctttgtgaagaaaaatcataaaaaaggagagaaacaaacaattttggtgtcaaactccaataattcagcataactaaactacaagaagaagctgaagca

SEQ ID NO: 564 - DNA, 1959 bp, Oryza sativa
agcgcgcagcgtctctctctctcgctctcgctatctatctctgtccttgtcactgtccgtccttgactcgctagcccaagaagaagaccaaccggagaggggaggggaggggaggcggagagatggctccgagctcgtcgtcctgccacgacgcggccgcgtcgatgctgctctgcgccgaggacaacagcagcatcctgtggctggaggatgaggagggggaggtgggggagaggaggagcggcggttgccggtcgatggtcggggacctcgccgccggcggcggcggcggcagcggcgggggtggagtggaggaggaggaggacatgttcccgcggcagtcggaggagtgcgtggcgagcttggtggagagggagcaggcgcacatgccgagggcggactacggcgagcggctccgcggcggcggcggcgacgtggatctccgcgtccgcagcgaggccatcggctggatttgggaggtttacacttactacaacttcagctctgtcactgcctatctggctgtaaactacctggaccgtttcctgtctcagtacgagctgccggaaggcagggattggatgacacagttgctctcggttgcgtgcttgtctatcgccgccaagatggaggagaccgtcgtcccgcaatgtttggatcttcagattggggaaccacggtttttgttcgaggtggagacgatccatagaatggagcttcttgttctcaccaacctcaattggaggatgcaagccgtgactccattctcctacatcgactacttcctacgaaagctcaacagcggcaatgccgcgccgagaagctggctcctgaggtcgtcggagctcatcttgcgcatagcagcaggaactggattcctagagtttagaccctcggagatcgctgcagcggtggctgccacagtggccggagaagccaccggcgtggtagaagaagacatcgcagaggctttcacccatgtagataaggggagggtgttgcaatgccaggaagcgattcaggatcatcactactccatggccaccattaacactgtgcaacctaaacctgcaagcaccaggagaggctcagcctcagcctcctcctcctctgtgcctgagagccctgttgcggtgctggatgctggctgcctcagctacaaaagtgatgatactgatgcagcaactattgcctcacatggaggaggaagaaggaagagttgctttgatagctccccggtcactagcaagaagaggaggaagcttagcaggtgactgaccagtcaaagtgccaaatgatagatcactctctctgtagtctgtacaccactcatctcgacaaaggcaaagtcaattggtttcgattgcaacgactgttagaaagaaagaacactggaagggggccaaaagggagggaattttgacatgacgagagagagctagctagcaagaagttgctgatgaataaagaggtgaggttgacaacacctaattgctaagcttttgcaagccagcaagccatggtgatgagaggtgcccccaaagaacaaagaaaagctttgtagcaacataaaagcttgatgagtttcaaaaaaaaaagaagaaaaaaaacataaaagctacatgagatgatcaagacaaaggatggtgaggggctttaggcaacaagtccaagaactaggcatgcactgacctggctgtgtagtattcttttgttcactagctctagttgcattagttgcagtattgttttcttttttccatttcatttgtaaggagaaaattagaggcggcagcactcctttttgtgatcagcaatgatgatcatccacatgaataaaataacatggtgtaaccagaaaagaaaattaacaagacccagaaaaagaggaaatgggtttctttcagtatattgctctgcctgcctatctctatattgtttgactgcttgtctgcttta

SEQ ID NO: 565 - DNA, 1859 bp, Oryza sativa
ctcttccccaggagacctctcctctgtctctcccctcctttttccactttccaagacaacgcaccaacaaaagcgtcgcccctcttcctcctcctcctccacctccattgctgcgccctctccctctccctctcgcctccctaggccactcactccccaaaacaccaccaacctcctttcctctctctctcttcttgagttcttgaatcaatgcgttcttgagttcttgaatcaataccagtatcacttgtgctaatagtactagaggaggaggtgttgtttcttgcgatcttgggttgattgatatgggtgttctttgcttcggcgcttccaacatcctcctctgcgcggaggacagcagcagcgtgcttggcctgggcggctttggcggcggcggcggcgaggtggcggcggagctggggtgcggcggcggtggcggctttgatttctttggcttcggtggtggtgctgtgttccccatcgactccgatgagttcgtggcgttgttggtggagaaggagatggatcatcagcctcagcgggggtatctggagaagctggagctcggtggattggagtgttcttggaggaaagatgccattgattggatttgcaaggtccattcctactacaactttggaccactcagcctttacctcgcagtgaactacctggataggttcctctcctcgtttaatctccctcatgacgaatcttggatgcaacagttgctgtcagttagttgtctatctcttgctacgaagatggaggagaccgtggtccctcttcccatggaccttcaggtttttgatgcggaatatgtgtttgaagcaaggcatattaagaggatggagcttattgtgatgaaaaccctgaaatggaggctgcaagctgtgaccccattctctttcatcggctacttcctggacaagttcaatgaagggaagccgccgagctacacgctggcatcatggtgctctgatctcacagtgggcactctgaaagactctaggttcttgtcattcagaccttctgagattgcggccgcagtggtgttagctgtgcttgctgagaatcagtttcttgtcttcaacagtgcccttggagaatctgaaatccctgtaaataaggagatggttatgagatgctatgagctgatggtagagaaggcattggtgaagaagataaggaacagcaatgcaagctcttcagttccacacagcccgatcaccgtgttggacgcggcgtgcttcagttttaggagtgatgacacaacactaggatcatcacagtcaaacagcaacaacaaagattacaacagccaggactctgctcctgcttccaagaggaggagattaaacacaacaccaatctgataactgtacatacataacttggcattgctttgcaattgttcattcagtgagcaactcatcagggtagcaagtagtggtgcatggcgagcatcatcataacaagcaaggatgaaagtgagcagtaataagctagtatcagcttcttgaactctggatgaagagagaaagggtgtgttttgaggagaggaggaagtcttcttcctcttgcagttttgttcccctttcctcctgcttctatttatctttttcttccccttctctgagcagagaaatctttgtggatatgagattggagatgtgaggatgtgagagaaaatcaacaaaaagaatttcgttttgttcctttattctttcaccatataaaaacgattcatggtgtgagaaattctgccattatttttttcatctgaattctggtaaaggtgtgcttctgattcatcaatgagttgactgcttgtctgcgagacctgcatttctctctta

SEQ ID NO: 566 - DNA, 1137 bp, Sorghum bicolor
atggcgccgatgagcagctacgagatggcggcttccatcctgctgtgcgccgaggacagcagcagcatcctggacctcgaagcggaggccgaggaggaggaagtgatgctggcgccacggagcaggaccaggacgcgcggggagcccagcgtggagttccccgtgccctccgaggaatgcgtcgacggtttcgtggaggcggaggcggcgcacatgccgcgggaggactacgccgagaggctgcgcggcggcggaatggatctccgcgtccggatggacgccatcgactggatttggaaggttcacaggtactacggtttcggccctctcactgcctgcttggccgtcaactacctggaccgcttcctctcgctctaccagcttccggaaggcaaggcttggacgacgcagctgctgtccgtggcgtgcttgtccctggctgccaagatggaggagacctacgttcctccgtctctggacctgcaggtcggcgacgcgcggtacgtgttcgaggcgaagacgatccagaggatggagctcctggtgctcagcacgctcaaatggaggatgcaagcggtcactcccttctcctacatcgactacttcctccaccggctcaacggcggcggcggcgacgcgccgagcagacgcgccgtccttcgctccgcggagctcatcctgtgcatcgcaagagggacgcactgcttggatttcaggccctcggagatcgccgcggccgtcgccgccgccgtggccggcgaagagcacgccgtggatatcgtcgacaaggcttgcacccaccgtgtacataaggagagggtgtcgcgatgccttgaagccatccaggccgccaccgtggccctgccgggcaccaccgtgccgcagccgctgatgaagacggaaggcacgagcagcggccgcagagccgcctcctctggcaccgccaccaccgtgccgcggagccccaccggggtgctggacgctgcaggctgcctcagctacaggagcgatgacacggcagcagctgctgctgctgccgccgcctcctcgcatgcgaccagctcctggcgcgacgaggacgacgacagctcctccccggttgttgtttgcagcaagaggaggaagattagcagatga

SEQ ID NO: 567 - DNA, 1122 bp, Sorghum bicolor
atggcgccgagctgctacgacgtggccgcgtccatgctcctctgcgccgaggagcacagcagcatcctgtgctttgaggaggaagaggaggaggagttgcaagtggtggggagaaagagagcccggtcgccggagccggactacggggacgatttcggcgtggatttgttcccgccgcagtcggaggaatgcgtggccggtctggtggagaaggagcgggaacacatgccgaggtccgactacggcgagaggctgcgcggcggcggcggcgacggcatcgatctctgcgtccgccgggaagccatcgactggatttggaaggtttacacatactacaactttcgtcctctcactgcctacttggcagtgaactatcttgatcgtttcctctcacggtacgagctgccggacggcaaggactggatgacacaactcctctcggtggcgtgcgtttctctagccgccaagatggaggaaactgccgtccctcaatctctggaccttcaggtcggagatgcgcgctatgtgtttgaggccaagacgatccagagaatggagctccttgttctgagcaccctcaattggaggatgcaggccgtgacacctttctcctacatggattacttcctaaacaagctcaatggtggcaacgcggcgccaagaagctggttctttcaatccgcagagcttatcctctgtgcagccagaggaacctgctgcatagggtttaggccgtctgagatcgccgcggcagttgcggcagccgtggtcgtcggagaagggaacgtcgcaggcattgagaacgcctgccttcacgtagacaaggagcgggtgttgctgtgccaggacgcgatccagtccatgtccatggcgtcctcggccattgacactgtgccaccaaagtctgcgagcggcagcggcaggacctccacctcctcccctgtgcctgtgccatggagccctgtaggggtgctggacgctgctggctgcctcagctacaagagcgaagacgatgccgccggggcagcagcgactgttgctgctgcctcacatggggcctctggctcttcaagctcatcgcccccagtgaccagcaaaaggcgaaaactcaccagccgatga

SEQ ID NO: 568 - DNA, 1038 bp, Sorghum bicolor
atgggaatcgtctgcgtcgatgcatcctccacgctgctctgcgaggaggacaggagcaacgcactcggcctcgtcggctgctgcgacgagctgctagaggtggggagcggccttgatggcttggactccgccgacggcgccgtgttgcccgtgcacaccgatgaggccgtgtcggcgttggtggagaaggagatggaccaccaacctcaagagggctatgcggagaggctggagcgcggcggattggagtcctcctggaggagagacgccatggattggatttgcaaggttcattcacactacagctttgcaccactcagtctttaccttgctgtgaattacctggatagattcctctccttgtatgagctcccacacgataagccttggatgcaacagttgttgtcagttgcttgcctatctcttgctgtcaagatggaggagaccgtggtcccttttcctgtggaccttcaggtttgcgatgtgaaatttgagtttgaaggaaagactattgggaggatggaggttcttgtgctgaaaaccctgaagtggagaatgcaggctgtgaccccgtttactttcatcagctacttcctggacaagttcagtgatgggaagccaccgagttttgcactttcctcacggtgtgctgagatcataattggcacactcaaaggctctacattcttgtcattcagaccatctgagattgctgcggcctcggccctagcagtggtttctgagaatcagattgttggctttgcgagtgttctttcagcatctaaagtccctgtaaataaggacatggttgctagatgctatgagctgttgcaagagcaggtgttggtgaagaagagaaggcacatcaatggaagcgcttcagtgccacaaagcccgattggtgtgctggatgcaacatgcttcagctttaggagcgaagatgcaacactaggatcatcacaatcaaacaacatcagtagtagtgacaacaacaatcaagcttccaagaggagaaggctaagcatatcaccaatctga

SEQ ID NO: 569 - DNA, 2218 bp, Zea mays
atggcaaaccctggcgaagggggccttgatagcggccggtcactctggccgcgtcaaccggcgcgtccaatcacatctgccgatccacgatcagacggccagtggctcgcgggacgcctcccaaacgccggatccatccacgcgttcggcaatgctcgcctttcctgcaccagtcgcgacagtccgcctcctccattcccgctccggctgtctcaattttggcgtaccaccgcgtgcgctttcccgaaatactttcgccatctccccgatacaaagcacgaagtggagagggcgcggcacagccaggcagccgcacggcacaactgcaccgcactctgcctcctccgcccgtcctccccccttgtcctcctccgctcggcactgccgcattctgctcttttagccaaacacgcgcaccagcccaccgcccagccggaccagagaggcggagactacagcgccggcgtcgcacggcaggagagggagacgcagccggaaaaaggcgcagactttgacttgctggtgtccggtgggagtgagatacgccggtacagagccatggcaccgagctgctacgacgtggccgcgtccatgctcctctgcgccgaggagcacagcagcatcctgtgttttgaggaggaggaggaggagttggaggcggtcgggagaaagagaggccggtcgccgggctatggggacgatttcggcgtggatttgttcccgccgcagacggaggaatgcgtggccggtctggtggagcgggagcgggagcacatgcctagggcggactatggccagaggctgcgcggcgacggcgtcgatctctgcgtccgccaggaggccatcgactgtatttggaaggtctacacatactacaactttcgtcctcttactgcctacttggcagtgaactatctcgatcgtttcctctcactgtacaagctgccggaaggcaagggctggatgacacaactcctttcggtggcgtgtgtttctctggctgccaagatggaggaaaccgccgtcccgcaatgtctggaccttcaggtcggagatgcacgttttgtgttcgaggcgaagacgatccagagaatggagctccttgttctaaccaccctcaactggaggatgcaggccgtgacacctttctcctatgtggattacttcctaaacaggctcagtggcggcaatgcggccctaagaaattgcctgtttcaatccgcggagcttatcttgtgtgcagctagaggaaccagctgcatagggtttaggccgtctgagatcgcggccgcagttgcagctgctgtggtcggagaagtggacgttgcaggcattgagaacgcctgcgcccacgtagataaggagagggtgttgcggtgccaggaggcgatccagtccatggcgttccctgtgcctgtgccgcagagccctgtgggggtgctggacgcgggctacctcagctacaagagcgaagacgatgccgcggcagcagcgactgctgcttcacatgggggcctctggctcttcaagctcctctccggtgaccagcaaaaggagaaaactcaccagccgatgatgggttgcagtgacctgccaaagtgtgtgcccaaatgatcagaggaaattgactactctgcttactttgatttttttttttagccgcgccactcgtctccgtgatgtgtgaagtgcaacgacgctggtgatgtgtgaagtgccttagcggcaaaaagacgggattttgacatgtcgaggggggcaagaagttgatgaataaaggtgtgaggtggacaacacctaaattgctgagctcttctttgcaagcaccggaggaggtagacagccagcacaaacttggtgtgccacaaagggcgcaccattgctttgtaggaacacaaagctggagggagatcgatgagatgatcagaataaagatggtgtagtcctggagtgggccagatcgtaggcaataatatctacaagaactaggcacactgaccagcctatgttggagtatctgataaattgctttagtaggttctagtattctttctttctttagtttcatcctgaagagaatctcggtgaccgagaaatgtatgtgacaaaataagagaagtcgacactgatgattaaactaagagctaacataaggaaaggaagtgaacaggatccatgacaaagcggagtgggcttagttcagtaataccaatacaac

SEQ ID NO: 570 - DNA, 2079 bp, Zea mays
ccccgctctccactggtctctctcctcctgtttccgcactgcagtggcctagccggcgtcgtcctccccctctctcgctcctctgtcctcccctctccacttgagaagaacacaattaggaaaaaaaggcaaaaaacatttaccttttttctatctgtatattatctgaataaatcaagaggaggaagaggggagggagcgagggagggggaggagtagcaaatccagactccatagcaaccagctcgcgagaaggggaaaagggggaggaagagcttcgcttgtgtattgattgctcgctgctccagtccctgcattcgtgccgtttttggcaagtaggtggcgtggcaagcatggtgccgggctatgactgcgccgcctccgtgctgctgtgcgcggaggacaacgctgctattctcggcctggacgacgatggggaggagtcctcctgggcggccgccgctacgccgccacgtgacaccgtcgccgccgccgccgccgccgccaccggggtcgccgtcgatgggattttgacggagttccccttgctctcggatgactgcgttgcgacgctcgtggagaaggaggtggagcacatgcccgcggaggggtacctccagaagctgcagcgacggcatggggacctggatttggccgccgtcaggaaggacgccatcgattggatttggaaggtcattgagcattacaatttcgcaccgttgactgccgttttgtctgtgaactacctcgatagattcctctccacgtatgagttccctgaaggcagagcttggatgactcagctcttggcagtggcttgcttgtctttggcttcgaaaatcgaagagacttttgtgccactccccttggatttgcaggtagcggaggcaaagtttgtttttgagggaaggaccataaaaaggatggagcttctggtgctaagcaccttaaagtggaggatgcatgctgttactgcttgctcatttgttgaatactttcttcataaattgagtgatcatggtgcaccctccttgcttgcacgctctcgctcttcggaccttgtcttgagcaccgctaaaggtgctgaattcgtggtattcagaccctccgagattgctgccagtgttgcacttgctgctatcggcgaatgcaggagttctgtaattgagagagctgctagtagctgcaaatatttggacaaggagagggttttaagatgccatgaaatgattcaagagaagattactgcgggaagcattgtcctaaagtctgctggatcatcaatctcctctgtgccacaaagcccaataggtgtcctggacgctgcagcctgtctgagtcaacaaagcgatgacgctactgtcgggtctcctgcagtatgttaccatagttcttccacaagcaagaggagaaggatcactagacgtctactctaattgtggtacgcttcaggtgtgctcctcaccgctctaggagtttttgattggttcaaacatcttaaatttagtttggccgctggaggattatggtttagtcaagtagttgctgaatggaacaacaaaacacgcacactacttggtccataaagacaagaaaataactggcagcgtcccgcgagccagcgctgcaatccagttcatgcaagaccctagagtccagggggggtgctggtgtaggtagagagggaacaaggcattcacatacgccgtagagatgagagagcctctcgtatgttttgtacttttgctccttcagtttgcaatgaactatataaacaaggattgccttggggcagtgaacatttgtcggatgaaaagaatcaaaaaggatgggggtcggcagaggaatagaacaatttgatatatttccataaactacagatatgtttcctttttcataatgatgagctatcatttttgttgatggtaacatggtatttggcgtcccgttttgtttgcatcaggccattggttgattgcttccaatgtaccttcattgattatccaatttttgtttgcattgggccattagttgattacttccaatgtaccttcattgattatccaatttttgtttgca

SEQ ID NO: 571 - DNA, 2115 bp, Zea mays
ccctcgtctctatccaaaacccgctccaccaccaccatcactattcactaggcacagcgcccggccgccctacataaaccctgctctcctccactccactagtctctctcctactgtttacacactgcagtggccttgccggcgtcttcctccccctcctctctctcgctcctctgtcctctccacttgataaagaacacaattaggaaaaaataggcaaaaaaacatgtaccttttttctatctatattatctgaataaatcaagaagaggaagaggggagagggagcagggagggggaggagtagcaaatccagactccatagaatcagctcgcaagaaggggaaagggaggaggagcttcgctggtgaattgattgctcgctgctccagtctcgcattcgtgccgttttcggcaagtaggtggcgtggcaagcatggtgcctggctatgactgcgccgcctccgtgctgctgtgcgcggaggacaacgctgctgttctcggcctggacgacgagtcctcttgggcggccgcagctacgccgccacgcgacaccgtcgtcgccgccgccgccgccggggttgccgtcgacgggttcttgacggagttccccttgctctcggatgactgcgttgcggcgctcgtggagaaggaggtggagcacatgcccgcggaggggtacctccagaagctgcagcgacggcatggggacctggatttggccgccgtcaggaaggatgccgtcgactggatttggaaggtcattgaacattacagtttcgcaccgttgactgcagttctgtctgtgaactacctcgatagattcctctccacctatgactttcctgaaggcagagcttggatgactcagctcttagcagtggcatgcttgtctttggcttcgaaaatagaagagacttttgtgccactccctttggatttgcaggtagccgaggcaaagtttgtttttgagggaaggaccattaaaaggatggagcttctggtgctacgcaccttaaagtggaggatgcatgctgttactgcttgttcatttgttgaatactttcttcataaattgagtgaccatggtgcaccctccttgcttgcgcgctctcgctcttccgaccttgtcttgagcactgctaaaggtgctgaattcgtggtattcagaccctcagagattgctgccagtgttgctcttgcggcgatcggggaatgcagcagttctgtaattgagagagctgctactagctgcaactatttggacaaggagagggttttaagatgtcatgaaatgattcaagagaagattgctgtgggaagcattgtcctaaagtctgctggatcatcaatttcctctgtgccacgaagccccataggcgtcctggatgccgctgcctgtctgagtcaacaaagcgatgatgctactgttggatctcctgcagtatgctaccatagttcttccacgagcaagagaagaaggatcactagacgtctactctagttgtggtatgcttcaggtgtgctcctcaccgttctaggagtttttgattggttcattcatcttaaatttagtttggcctctcaaggattatggtttcgtcaagtagttgcctgaatggaacaacaaaacatgcacactactcagtgttccatataaagagagagagaaaaataacaagcagcgtcctgcgagccagtgttgcgattccagttcatgcaattggcatccgtaaggggaatgcaagcgcaagacactagagtccagggatgctggtgtaggtagagagggggaacaaggaatttacatacggcatagagatgagagctctctcgtaccattttgtaccttcaattcgcaatgaactttaggcaaggattgccttgggcaattgaacatttgtcgggtgagaagaatccaaagatggatcggcagaggaatagaacaatttgatatatttccataaactacagatatgttttattttttcttaatggtgagctgtcacttgttgatagtaatatggtattcggcgttccgttttggttgcgctggggccattggttgattatgaccaatgtaccttcattggttattcttgattgcgagtattt

SEQ ID NO: 572 - DNA, 2152 bp, Zea mays
cgctccggatgtctccagtttcggcgtaccgccgcgtgcgcttcccaaaacactcccgtctccccgtgcccgatacaaagcgcgagggggcgaaagcacgccacaactgcaccgcactctctgcctccctccgtccgtccgtcctcccgtcctcttccttgtgccttgtcctgcttctccactcgccactgccgcattctgcccaagtttgccgtactgccgcattccaccagccacccaccaggccaccacccagcactccagccgccagaacagagtctacggcgccgccgtcgcacgacaggagagggagagggagagagacgcgggctttgacttgccgccggtgcgtccgtgcgtgcctggtgggaggagtgggagacgccggtacagtacaggagccatggcgccgagctgctacgacgcggcagcgtccatgctcctctgcgccgaggagcacagcagcatcctgtggtacgacgaggaggaggaggagctggaggcggtcgggagaaggagaggccggtcgccgggctacggggacgacttcggcgcggacttgttcccgccgcagtcggaggaatgcgtggccggtctggtggagcgggaacgggaccacatgccggggccgtgctacggcgacaggctgcgcggcggcggcggctgtctctgcgtccgccgggaggccgtcgactggatttggaaggcttacacgcaccacaggttccgccctctcactgcctacttggcagtgaactacctcgatcgcttcctctcgctgtctgaggtgccggactgcaaggactggatgacgcagctcctcgcggtggcgtgcgtttctctggccgccaagatggaggaaaccgccgtcccgcagtgcctggaccttcaggaggtcggagacgcgcggtacgtgttcgaggcgaagacggtccagaggatggagctcctggttctaacaaccctcaactggaggatgcatgccgtgacgccgttctcctacgtggattacttcctgaacaagctcaacaacggcggcagcacggcgccgaggagctgctggctcttgcagtccgcggagcttatcttgcgtgcggccagaggaaccggctgcgtcgggttcaggccgtccgagatcgccgccgcggttgcagccgccgtggccggagacgtggacgacgcggacggcgtcgagaacgcctgctgcgctcacgtagataaggagcgggtgttgcggtgccaggaagcgatcgggtccatggcgtcctcggcggccattgacgacgctaccgtgccaccgaaatctgcgagacgcaggagctcccccgtgcccgtgccgcagagccctgtgggggtgctggacgcggctccctgcctcagctacaggagcgaagaggcagcgactgcgactgcgactgcgacttctgctgcctcacatggggcccctggctcttcaagctcgtcctcgacctccccggtgaccagcaaaaggaggaaactcgccagccgatgtgatggatcgtgcagtgaccggtcaaagcgcgcgcccgcccaatggaccaaagagtgaattgactagggcgtctgcttgctttctgatcaaagagtgcattgagaggcggcaaaatggaggaataaaggggattttggcatgacgagggcaaaggagttgatgaataaagacgcgacgaggtggacaacacctaaattgccgatcttttctttgcaaggggagtaggggacctgcttgggcctgggggagggtagtagacagcccagcacaaaaacctggttggtgtgccacgaccacaatgggcgcgccagccatggctttgtaggaaacacaagggcgctagaggagatccgatgggatgactcagaataaagatagtggagggaccagaccgtatgcagtatgtgcaacaactaggcactggcatgcttatgctcaagtaatctgataacttgaatgttgtgtatccgacaaactgcttctgtgaagagagaaatgcaggtagacgatgaatgtatgtgacaaaaagaatgtccgacccagatgagaaaataaaatatgaatccatgacaaggggatgtgggtttagttctatccatcatttgtttttaattttaacttaatattgtcctgcctgcc

SEQ ID NO: 573 - DNA, 1388 bp, Zea mays
ccgaaaatgcccccgcctactctgcacgccggttcatacaaaaggggcctcacgtcacggcacacagcacgcagcacatcgctcactccgtcactcgctcctcctccactcctcgccttcctcggtcgcatcaagaacacgagcaggaaggagaagaggaggagtcctatcagagccagacagccaatcagtatctgtaccattaccgttcgggcaccagattaccaaaatcctgcagaggggaatggcgccgagcagctacgagatggcggcttccaccctgctgtgcggcgaggacagcagcagcatcctggacctcgaagcggggggccaggaggaggaggaggaggtgctgctggcgcggagcaggacgcgcggggagcccagcgtggtcttccccgtgccgtccgaggaatgcgtcgccggtttcgtggaggcggaggcggcgcacatgccgcgggaggactacgccgagaggctgcgcggcgggggcacggatctccgcgtccggacggacgccatcgactggatttggaaggttcacgcgtactacggtttcggccctctcaccgcctgcttggccgtcaactacctggaccgcttcctctcgctctaccagcttccggaaggcaagtcttggacgacgcagctgctgtccgtggcgtgcttgtccctggctgccaagatggaggagacctacgttcctccgtctctggacctgcaggtcggggacgcgcggtacgtgttcgaggcgaagacggtgcagaggatggagctgctggtcctcagcacgctcagatggaggatgcgagcggtcacccccttctcgtacatcgactacttcctccaccggctcaaagacggcggtgcgccgagcagacgcgccgtcctccgatccgcggagctcatcctgcgcgtcgcgagaggaacgtgctgcctgggtttcaggccctcggaggtcgccgcggctgtcgccgccgccgtggccggcgaggagcacgccgtggatatcgacaaggcttgcacccaccgcgtgcacgaggtacggcgtgtgcctgtccccggccacttctcgcgagtcttgtcgtcagattcaatgcgatgcgatgcaatacgttaagcgtgtaccgcatggatccaaatccaagtcgtaggtttgcagctgtacttgacttgtgcagctactgagctactactactaggcacacgcacctgcccaggtcaggtgcgtgagccgcatttacagccatggcgactgatgctttatttgttgctttgcgctgcatgcgggcggttgcaggagagggtgtcgcgatgcctcgaagcgatccaggccaccgtggccctgctggcgcctgcacagccgctgaaagctgaaggcccgagca

SEQ ID NO: 574 - protein, 361 aa, Arabidopsis thaliana
MAENLACGETSESWIIDNDDDDINYGGGFTNEIDYNHQLFAKDDNFGGNGSIPMMGSSSSSLSEDRIKEMLVREIEFCPGTDYVKRLLSGDLDLSVRNQALDWILKVCAHYHFGHLCICLSMNYLDRFLTSYELPKDKDWAAQLLAVSCLSLASKMEETDVPHIVDLQVEDPKFVFEAKTIKRMELLVVTTLNWRLQALTPFSFIDYFVDKISGHVSENLIYRSSRFILNTTKAIEFLDFRPSEIAAAAAVSVSISGETECIDEEKALSSLIYVKQERVKRCLNLMRSLTGEENVRGTSLSQEQARVAVRAVPASPVGVLEATCLSYRSEERTVESCTNSSQSSPDNNNNNNNSNKRRRKQ

SEQ ID NO: 575 - protein, 308 aa, Arabidopsis thaliana
MAEENLELSLLCTESNVDDEGMIVDETPIEISIPQMGFSQSESEEIIMEMVEKEKQHLPSDDYIKRLRSGDLDLNVGRRDALNWIWKACEVHQFGPLCFCLAMNYLDRFLSVHDLPSGKGWILQLLAVACLSLAAKIEETEVPMLIDLQVGDPQFVFEAKSVQRMELLVLNKLKWRLRAITPCSYIRYFLRKMSKCDQEPSNTLISRSLQVIASTTKGIDFLEFRPSEVAAAVALSVSGELQRVHFDNSSFSPLFSLLQKERVKKIGEMIESDGSDLCSQTPNGVLEVSACCFSFKTHDSSSSYTHLS

SEQ ID NO: 576 - protein, 298 aa, Arabidopsis thaliana
MAEFMEPNLVSNFDDEKSNSVDTRSIFQMGFPLESEEIVREMIEKERQHSPRDDYLKRLRNGDLDFNVRIQALGWIWKACEELQFGPLCICLAMNYLDRFLSVHDLPSGKAWTVQLLAVACLSLAAKIEETNVPELMQLQVGAPMFVFEAKSVQRMELLVLNVLRWRLRAVTPCSYVRYFLSKINGYDQEPHSRLVTRSLQVIASTTKGIDFLEFRASEIAAAVALSVSGEHFDKFSFSSSFSSLEKERVKKIGEMIERDGSSSSSQTPNNTVLQFKSRRYSHSLSTASVSSSLTSLS

SEQ ID NO: 577 - protein, 328 aa, Glycine max
MAPSFDCVSSLLCAEDNSIFDENDYGDIVETLVKSDECLRLMVEKEWDHLPNGDYVNRLRSGDLDFGARKEAIDWIEKVQQHFGFGPLCAYLSINYLDRFLSAYELPKHRAWTMQLLAVGCLSLAAKMEETDVPFSLDLQVGESKYIFEAKTIQRMELLVLSTLRWRMQAITPFSFIDHFLYKINDDQSPIGASILQSIQLILSTVRGIDFLEFRPSEIAAAVAISVVGEGQTVHTEKAISVLIQLVEKERVLKCVKMIQELASNSGGSAKGASASVSVPSVPESPLGVLVTACFSYKSDDTNAASYANSSHNISPDAKRRKLNKTFG

SEQ ID NO: 578 - protein, 357 aa, Glycine max
MAPSFDCVSSLLCVEDNSIFDENDYGGSVEVLEDAWQDPRYRRNLSQSENLDVPNGWFQLQSDECLRLMVEKEWDHLPNGDYRNKLRSGDLDFEARKEAIDWIQKVQEHFGFGPVCAYLSINYLDRFLSAYELPKHRTWTMQLLAVGCLSLAAKMEETDAPMSLDLQVGESKYIFEAKTIQRMELLVLSTLRWRMQAITPFSFIDHFLYKINDDQSPIGASILQSIQLILSTVRGIDFLEFRPSEIAAAVAISVVGEGQTVQTEKAISVLIQLVEKERVLKCVKLIQELASNSGGGSAKGDSASVSVPSVPQSPIGVLNTECFSYKSDDTNAASCANTSHNNSPDAKRRKLNKTFGE

SEQ ID NO: 579 - protein, 361 aa, Glycine max
MAHNSDSATSNLLLCSENSSTCFDDDLECCDAADGSNSRISHQFWDHHEGGGGGGSELLACFVAQSEETVRAMVEREREHLPRDDYLMRLRSGELDLGVRREAIDWICKAHSYFGFGPLSFCLAVNYLDRFLSVFDLPRGVTWTVQLLAVACLSIAAKMEEIKVPQSVDLQVGEPKFVFEARTIQKMELLVLSTLGWKMCAITPCSFIDYFLGKITCEQHPAKSSVSISVQLILGIIMGIDYLEFRPSEIAAAVAVSVLKELQAIEIDKAIIDLLVVEKVRVLKCVELIRDLSLINVAASLGSKVPYVPQSPIGVLDAGCLSYKSDELTVGSCPNSSHNISNPNPTKRSKPDGPSNGTSNS

SEQ ID NO: 580 - protein, 310 aa, Glycine max
CLIKDNHGSEHFWDFSVLSDETVMDLVGRESEHLPHVGYLKRLLSGDLDLSVRNEALDWIWKAHAYYGFGPCSLCLSVNYLDRFLSVYELPRGKSWSIQLLAVACLSIAAKMEEIKVPPFVDLQVGEPKFVFEAKTIQRMELLVLSTLRWQMQASTPFSFLDYFLRKINCDQVIVKSSIMRSVGPILNIIKCINFLEFRPSEIAAAVAISVSREIQAEEIDKALQMQAEETAAAFTAFCFLSYEGLELIKDLSLMQDSANLGNNLASFVPQSPIGVLDAACLSSISDELTVGSYRDSSLDTPNSKRRKSD

SEQ ID NO: 581 - protein, 436 aa, Oryza sativa
PASVGSCPVSASCPAQNALLLPSTRLCIQRERIPPLLTCPLLLFHTSPPTKIKSKNSKSKKRRRETTQSITSLARFISKEMAALTSYEMAASILLCAEDSSSVLGFGGEEEEEEEDVVAGKRARCAGPPPPPCVDVAGVDFAVPSEECVARLVETEADHMPREDYAERLRAGGGDGDLDLRVRMDAIDWIWKVHSYYSFAPLTACLAVNYLDRFLSLYQLPDGKDWMTQLLAVACLSLAAKMEETDVPQSLDLQVGEERYVFEAKTIQRMELLVLSTLKWRMQAVTPFSYVDYFLRELNGGDPPSGRSALLSSELILCIARGTECLGFRPSEIAAAVAAAVVGEEHAAFSHVNKERMSHCQEVIQAMELIHPKPSSPSRVFVSSSIPRSPTGVLDAAGCLSYRSDDSAVASHYAASSWGYEHDSSPVSSKRRKISR

SEQ ID NO: 582 - protein, 399 aa, Oryza sativa
PKKKTNRRGEGRGGGEMAPSSSSCHDAAASMLLCAEDNSSILWLEDEEGEVGERRSGGCRSMVGDLAAGGGGGSGGGGVEEEEDMFPRQSEECVASLVEREQAHMPRADYGERLRGGGGDVDLRVRSEAIGWIWEVYTYYNFSSVTAYLAVNYLDRFLSQYELPEGRDWMTQLLSVACLSIAAKMEETVVPQCLDLQIGEPRFLFEVETIHRMELLVLTNLNWRMQAVTPFSYIDYFLRKLNSGNAAPRSWLLRSSELILRIAAGTGFLEFRPSEIAAAVAATVAGEATGVVEEDIAEAFTHVDKGRVLQCQEAIQDHHYSMATINTVQPKPASTRRGSASASSSSVPESPVAVLDAGCLSYKSDDTDAATIASHGGGRRKSCFDSSPVTSKKRRKLSR

SEQ ID NO: 583 - protein, 381 aa, Oryza sativa
INTSITCANSTRGGGVVSCDLGLIDMGVLCFGASNILLCAEDSSSVLGLGGFGGGGGEVAAELGCGGGGGFDFFGFGGGAVFPIDSDEFVALLVEKEMDHQPQRGYLEKLELGGLECSWRKDAIDWICKVHSYYNFGPLSLYLAVNYLDRFLSSFNLPHDESWMQQLLSVSCLSLATKMEETVVPLPMDLQVFDAEYVFEARHIKRMELIVMKTLKWRLQAVTPFSFIGYFLDKFNEGKPPSYTLASWCSDLTVGTLKDSRFLSFRPSEIAAAVVLAVLAENQFLVFNSALGESEIPVNKEMVMRCYELMVEKALVKKIRNSNASSSVPHSPITVLDAACFSFRSDDTTLGSSQSNSNNKDYNSQDSAPASKRRRLNTTPI

SEQ ID NO: 584 - protein, 378 aa, Sorghum bicolor
MAPMSSYEMAASILLCAEDSSSILDLEAEAEEEEVMLAPRSRTRTRGEPSVEFPVPSEECVDGFVEAEAAHMPREDYAERLRGGGMDLRVRMDAIDWIWKVHRYYGFGPLTACLAVNYLDRFLSLYQLPEGKAWTTQLLSVACLSLAAKMEETYVPPSLDLQVGDARYVFEAKTIQRMELLVLSTLKWRMQAVTPFSYIDYFLHRLNGGGGDAPSRRAVLRSAELILCIARGTHCLDFRPSEIAAAVAAAVAGEEHAVDIVDKACTHRVHKERVSRCLEAIQAATVALPGTTVPQPLMKTEGTSSGRRAASSGTATTVPRSPTGVLDAAGCLSYRSDDTAAAAAAAAASSHATSSWRDEDDDSSSPVVVCSKRRKISR

SEQ ID NO: 585 - protein, 373 aa, Sorghum bicolor
MAPSCYDVAASMLLCAEEHSSILCFEEEEEEELQVVGRKRARSPEPDYGDDFGVDLFPPQSEECVAGLVEKEREHMPRSDYGERLRGGGGDGIDLCVRREAIDWIWKVYTYYNFRPLTAYLAVNYLDRFLSRYELPDGKDWMTQLLSVACVSLAAKMEETAVPQSLDLQVGDARYVFEAKTIQRMELLVLSTLNWRMQAVTPFSYMDYFLNKLNGGNAAPRSWFFQSAELILCAARGTCCIGFRPSEIAAAVAAAVVVGEGNVAGIENACLHVDKERVLLCQDAIQSMSMASSAIDTVPPKSASGSGRTSTSSPVPVPWSPVGVLDAAGCLSYKSEDDAAGAAATVAAASHGASGSSSSSPPVTSKRRKLTSR

SEQ ID NO: 586 - protein, 345 aa, Sorghum bicolor
MGIVCVDASSTLLCEEDRSNALGLVGCCDELLEVGSGLDGLDSADGAVLPVHTDEAVSALVEKEMDHQPQEGYAERLERGGLESSWRRDAMDWICKVHSHYSFAPLSLYLAVNYLDRFLSLYELPHDKPWMQQLLSVACLSLAVKMEETVVPFPVDLQVCDVKFEFEGKTIGRMEVLVLKTLKWRMQAVTPFTFISYFLDKFSDGKPPSFALSSRCAEIIIGTLKGSTFLSFRPSEIAAASALAVVSENQIVGFASVLSASKVPVNKDMVARCYELLQEQVLVKKRRHINGSASVPQSPIGVLDATCFSFRSEDATLGSSQSNNISSSDNNNQASKRRRLSISPI

SEQ ID NO: 587 - protein, 537 aa, Zea mays
MANPGEGGLDSGRSLWPRQPARPITSADPRSDGQWLAGRLPNAGSIHAFGNARLSCTSRDSPPPPFPLRLSQFWRTTACAFPKYFRHLPDTKHEVERARHSQAAARHNCTALCLLRPSSPLVLLRSALPHSALLAKHAHQPTAQPDQRGGDYSAGVARQERETQPEKGADFDLLVSGGSEIRRYRAMAPSCYDVAASMLLCAEEHSSILCFEEEEEELEAVGRKRGRSPGYGDDFGVDLFPPQTEECVAGLVEREREHMPRADYGQRLRGDGVDLCVRQEAIDCIWKVYTYYNFRPLTAYLAVNYLDRFLSLYKLPEGKGWMTQLLSVACVSLAAKMEETAVPQCLDLQVGDARFVFEAKTIQRMELLVLTTLNWRMQAVTPFSYVDYFLNRLSGGNAALRNCLFQSAELILCAARGTSCIGFRPSEIAAAVAAAVVGEVDVAGIENACAHVDKERVLRCQEAIQSMAFPVPVPQSPVGVLDAGYLSYKSEDDAAAAATAASHGGLWLFKLLSGDQQKEKTHQPMMGCSDLPKCVPK

SEQ ID NO: 588 - protein, 360 aa, Zea mays
MVPGYDCAASVLLCAEDNAAILGLDDDGEESSWAAAATPPRDTVAAAAAAATGVAVDGILTEFPLLSDDCVATLVEKEVEHMPAEGYLQKLQRRHGDLDLAAVRKDAIDWIWKVIEHYNFAPLTAVLSVNYLDRFLSTYEFPEGRAWMTQLLAVACLSLASKIEETFVPLPLDLQVAEAKFVFEGRTIKRMELLVLSTLKWRMHAVTACSFVEYFLHKLSDHGAPSLLARSRSSDLVLSTAKGAEFVVFRPSEIAASVALAAIGECRSSVIERAASSCKYLDKERVLRCHEMIQEKITAGSIVLKSAGSSISSVPQSPIGVLDAAACLSQQSDDATVGSPAVCYHSSSTSKRRRITRRLL

SEQ ID NO: 589 - protein, 355 aa, Zea mays
MVPGYDCAASVLLCAEDNAAVLGLDDESSWAAAATPPRDTVVAAAAAGVAVDGFLTEFPLLSDDCVAALVEKEVEHMPAEGYLQKLQRRHGDLDLAAVRKDAVDWIWKVIEHYSFAPLTAVLSVNYLDRFLSTYDFPEGRAWMTQLLAVACLSLASKIEETFVPLPLDLQVAEAKFVFEGRTIKRMELLVLRTLKWRMHAVTACSFVEYFLHKLSDHGAPSLLARSRSSDLVLSTAKGAEFVVFRPSEIAASVALAAIGECSSSVIERAATSCNYLDKERVLRCHEMIQEKIAVGSIVLKSAGSSISSVPRSPIGVLDAAACLSQQSDDATVGSPAVCYHSSSTSKRRRITRRLL

SEQ ID NO: 590 - protein, 388 aa, Zea mays
MAPSCYDAAASMLLCAEEHSSILWYDEEEEELEAVGRRRGRSPGYGDDFGADLFPPQSEECVAGLVERERDHMPGPCYGDRLRGGGGCLCVRREAVDWIWKAYTHHRFRPLTAYLAVNYLDRFLSLSEVPDCKDWMTQLLAVACVSLAAKMEETAVPQCLDLQEVGDARYVFEAKTVQRMELLVLTTLNWRMHAVTPFSYVDYFLNKLNNGGSTAPRSCWLLQSAELILRAARGTGCVGFRPSEIAAAVAAAVAGDVDDADGVENACCAHVDKERVLRCQEAIGSMASSAAIDDATVPPKSARRRSSPVPVPQSPVGVLDAAPCLSYRSEEAATATATATSAASHGAPGSSSSSSTSPVTSKRRKLASRCDGSCSDRSKRAPAQWTKE

SEQ ID NO: 591 - protein, 291 aa, Zea mays
MAPSSYEMAASTLLCGEDSSSILDLEAGGQEEEEEVLLARSRTRGEPSVVFPVPSEECVAGFVEAEAAHMPREDYAERLRGGGTDLRVRTDAIDWIWKVHAYYGFGPLTACLAVNYLDRFLSLYQLPEGKSWTTQLLSVACLSLAAKMEETYVPPSLDLQVGDARYVFEAKTVQRMELLVLSTLRWRMRAVTPFSYIDYFLHRLKDGGAPSRRAVLRSAELILRVARGTCCLGFRPSEVAAAVAAAVAGEEHAVDIDKACTHRVHEVRRVPVPGHFSRVLSSDSMRCDAIR

That which is claimed:

1. A method of producing a genome-edited, doubled haploid maize plantlet or plant, the method comprising:

(a) providing to a maternal gametophyte:

(i) a polynucleotide sequence encoding a parthenogenesis factor, wherein the polynucleotide sequence is operably linked to a regulatory element active in an egg cell, and wherein the parthenogenesis factor is an Ovule Development Protein 2 (ODP2) polypeptide having at least 95% sequence identity to SEQ ID NO: 20 and comprising a first motif having an amino acid sequence of SEQ ID NO: 36 and a second motif having an amino acid sequence of SEQ ID NO: 38; and (ii) a site-directed nuclease;

(b) modifying a DNA target site in the maternal gametophyte via the site-directed nuclease, resulting in a modified DNA target site;

(c) regenerating a $T_0$ plant containing the polynucleotide sequence encoding the parthenogenesis factor and the modified DNA target site;

(d) pollinating the $T_0$ plant with pollen;

(e) obtaining a genome-edited, doubled haploid embryo from a parthenogenic maternal gametophyte of the $T_0$ plant; and (f) regenerating a genome-edited, doubled haploid maize plantlet or plant from the genome-edited, doubled haploid embryo.

2. The method of claim 1, further comprising providing the parthenogenic maternal gametophyte with a genetic chromosome doubling agent, wherein obtaining the genome-edited, doubled haploid embryo from the parthenogenic maternal gametophyte comprises diploidization of maternal chromosomes of the parthenogenic maternal gametophyte via the genetic chromosome doubling agent resulting in a diploidized parthenogenic maternal gametophyte and obtaining the genome-edited, doubled haploid embryo from the diploidized parthenogenic maternal gametophyte.

3. The method of claim 1, wherein obtaining the genome-edited, doubled haploid embryo from the parthenogenic maternal gametophyte comprises:

obtaining a haploid embryo from the parthenogenic maternal gametophyte and contacting the haploid embryo with a chromosome doubling agent for a period sufficient to generate the genome-edited, doubled haploid embryo.

4. The method of claim 3, wherein the chromosome doubling agent is colchicine, a colchicine derivative, a carbamate, a benzamide, a benzoic acid, a dinitroaniline, a chloralin, a phosphoroamidate, or a pyridine.

5. The method of claim 1, wherein the pollen is from a haploid inducer.

6. The method of claim 1, wherein the pollen comprises a marker gene, wherein the marker gene is a selectable marker, a reporter gene, or a visible endogenous morphological marker.

7. The method of claim 6, wherein the selectable marker is GUS, PMI, or PAT, the reporter gene is GFP, RFP, or CFP, and the visible endogenous morphological marker is B1, R1-nj, R1-scm, or anthocyanin pigments.

8. The method of claim 6, wherein the genome-edited, doubled haploid embryo lacks the marker gene.

9. The method of claim 6, wherein obtaining the genome-edited, doubled haploid embryo from the parthenogenic maternal gametophyte and regenerating the genome-edited, doubled haploid maize plantlet or plant from the genome-edited, doubled haploid embryo comprises: obtaining mature seed from the $T_0$ plant, the mature seed having a diploidized maternal embryo lacking the marker gene and germinating the mature seed to obtain the genome-edited, doubled haploid maize plantlet or plant.

10. The method of claim 2, wherein the genetic chromosome doubling agent comprises a polynucleotide sequence encoding a polypeptide having at least 95% sequence identity to SEQ ID No: 111.

11. The method of claim 1, wherein the regulatory element comprises an egg cell promoter.

12. The method of claim 1, wherein the regulatory element comprises expression modulating element selected from SEQ ID Nos: 39-103 and/or an enhancer selected from SEQ ID Nos: 104-109.

13. The method of claim 1, wherein the site-directed nuclease is a meganuclease, a zinc-finger nuclease, a transcription-activator like effector nuclease, a Cas9 nuclease, a Cas alpha nuclease, a Cpf1 nuclease, a dCas9-FokI, a dCpf1-FokI, a chimeric Cas9-cytidine deaminase, a chimeric Cas9 adenine deaminase, a chimeric FEN1-Fok1, a Mega-TALs, a Cas9 nickase, a chimeric dCas9 non-FokI nuclease, or a dCpf1-non-FokI nuclease.

14. A method of producing a doubled haploid maize plantlet or plant, the method comprising:

(a) providing to a maternal gametophyte a polynucleotide sequence encoding a parthenogenesis factor, wherein the polynucleotide sequence encoding a parthenogenesis factor is operably linked to a regulatory element active in an egg cell, and wherein the parthenogenesis factor is an Ovule Development Protein 2 (ODP2) polypeptide having at least 95% sequence identity to SEQ ID NO: 20 and comprising a first motif having an amino acid sequence of SEQ ID NO: 36 and a second motif having an amino acid sequence of SEQ ID NO: 38;

(b) regenerating a $T_0$ plant containing the polynucleotide sequence encoding the parthenogenesis factor;

(c) pollinating the $T_0$ plant with pollen;

(d) obtaining a doubled haploid embryo from a parthenogenic maternal gametophyte of the $T_0$ plant; and (e) regenerating a doubled haploid maize plantlet or plant from the doubled haploid embryo.

15. The method of claim 14, wherein the pollen is from a haploid inducer.

16. The method of claim 15, wherein the pollen comprises a marker gene, wherein the marker gene is a selectable marker, a reporter gene, or a visible endogenous morphological marker.

17. The method of claim 16, wherein the selectable marker is GUS, PMI, or PAT, the reporter gene is GFP, RFP, or CFP, and the visible endogenous morphological marker is B1, R1-nj, R1-scm, or anthocyanin pigments.

18. The method of claim 16, wherein the doubled haploid embryo obtained from the parthenogenic maternal gametophyte lacks the marker gene.

19. The method of claim 16, wherein obtaining the doubled haploid embryo from the parthenogenic maternal gametophyte and regenerating the doubled haploid maize plantlet or plant from the doubled haploid embryo comprises: obtaining mature seed from the $T_0$ plant, the mature seed having a diploidized maternal embryo lacking the marker gene and germinating the mature seed to obtain the doubled haploid maize plantlet or plant.

20. The method of claim 14, wherein the genetic chromosome doubling agent comprises a polynucleotide sequence encoding a polypeptide having at least 95% sequence identity to SEQ ID No: 111.

21. The method of claim 14, wherein the regulatory element is an egg cell promoter.

22. The method of claim 1, wherein the site-directed nuclease is a Cas9 nuclease or a Cas alpha nuclease.

23. The method of claim 22, further comprising providing to the maternal gametophyte a guide polynucleotide.

24. The method of claim 14, further comprising providing the parthenogenic maternal gametophyte with a genetic chromosome doubling agent, wherein obtaining the doubled haploid embryo from the parthenogenic maternal gametophyte comprises diploidization of maternal chromosomes of the parthenogenic maternal gametophyte via the genetic chromosome doubling agent resulting in a diploidized parthenogenic maternal gametophyte and obtaining the doubled haploid embryo from the diploidized parthenogenic maternal gametophyte.

25. The method of claim 24, wherein the genetic chromosome doubling agent comprises a polynucleotide sequence encoding a polypeptide having at least 95% sequence identity to SEQ ID No: 111.

26. The method of claim 14, wherein obtaining the doubled haploid embryo from the parthenogenic maternal gametophyte comprises obtaining a haploid embryo from the parthenogenic maternal gametophyte and contacting the haploid embryo with a chromosome doubling agent for a period sufficient to generate the doubled haploid embryo.

27. The method of claim 26, wherein the chromosome doubling agent is colchicine, a colchicine derivative, a carbamate, a benzamide, a benzoic acid, a dinitroaniline, a chloralin, a phosphoroamidate, or a pyridine.

28. The method of claim 1, wherein the parthenogenesis factor is a fusion protein comprising the ODP2 polypeptide having at least 95% sequence identity to SEQ ID NO: 20 and a CBF1a domain having an amino acid sequence of SEQ ID NO: 449.

29. The method of claim 1, wherein the pollen is from a non-haploid inducer.

30. The method of claim 11, wherein the egg cell promoter is any one of SEQ ID Nos: 34 or 121-135.

31. The method of claim 11, wherein the egg cell promoter comprises an expression modulating element selected from SEQ ID Nos: 39-103 and/or an enhancer selected from SEQ ID Nos: 104-109.

32. The method of claim 14, wherein the pollen is from a non-haploid inducer.

33. The method of claim 21, wherein the egg cell promoter is any one of SEQ ID Nos: 34 or 121-135.

34. The method of claim 21, wherein the egg cell promoter comprises an expression modulating element selected from SEQ ID Nos: 39-103 and/or an enhancer selected from SEQ ID Nos: 104-109.

* * * * *